US012767959B2

(12) United States Patent
Gaudelli et al.

(10) Patent No.: US 12,767,959 B2
(45) Date of Patent: Oct. 20, 2026

(54) NUCLEOBASE EDITORS HAVING REDUCED OFF-TARGET DEAMINATION AND METHODS OF USING SAME TO MODIFY A NUCLEOBASE TARGET SEQUENCE

(71) Applicant: BEAM THERAPEUTICS INC., Cambridge, MA (US)

(72) Inventors: Nicole Gaudelli, Cambridge, MA (US); Yi Yu, Cambridge, MA (US); Ian Slaymaker, Cambridge, MA (US); Jason Michael Gehrke, Cambridge, MA (US); Seung-Joo Lee, Cambridge, MA (US); David A. Born, Cambridge, MA (US)

(73) Assignee: BEAM THERAPEUTICS INC., Cambridge, MA (US)

( * ) Notice: Subject to any disclaimer, the term of this patent is extended or adjusted under 35 U.S.C. 154(b) by 333 days.

(21) Appl. No.: 17/427,422

(22) PCT Filed: Jan. 31, 2020

(86) PCT No.: PCT/US2020/016288
§ 371 (c)(1),
(2) Date: Jul. 30, 2021

(87) PCT Pub. No.: WO2020/160517
PCT Pub. Date: Aug. 6, 2020

(65) Prior Publication Data

US 2022/0136012 A1 May 5, 2022

Related U.S. Application Data

(60) Provisional application No. 62/941,569, filed on Nov. 27, 2019, provisional application No. 62/835,456,
(Continued)

(51) Int. Cl.
*C12N 9/22* (2006.01)
*C12N 9/24* (2006.01)
(Continued)

(52) U.S. Cl.
CPC .............. *C12N 15/90* (2013.01); *C12N 9/22* (2013.01); *C12N 9/2497* (2013.01); *C12N 9/80* (2013.01);
(Continued)

(58) Field of Classification Search
CPC .................. C12N 2310/20; C12N 9/22; C12Y 305/04005; C12Y 305/04004; C07K 2319/00
See application file for complete search history.

(56) References Cited

U.S. PATENT DOCUMENTS

| | | | |
|---|---|---|---|
| 7,915,114 | B2 | 3/2011 | Hsiao et al. |
| 9,068,179 | B1 | 6/2015 | Liu et al. |

(Continued)

FOREIGN PATENT DOCUMENTS

| | | | |
|---|---|---|---|
| CN | 103088008 | A | 5/2013 |
| CN | 105934516 | A | 9/2016 |

(Continued)

OTHER PUBLICATIONS

Sawyer SL, Emerman M, Malik HS. Ancient adaptive evolution of the primate antiviral DNA-editing enzyme APOBEC3G. PLoS Biol. Sep. 2004;2(9):E275. doi: 10.1371/journal.pbio.0020275. Epub Jul. 20, 2004. PMID: 15269786; PMCID: PMC479043. (Year: 2004).*

(Continued)

*Primary Examiner* — Kimberly Chong
*Assistant Examiner* — Africa M McLeod
(74) *Attorney, Agent, or Firm* — Greenberg Traurig, LLP; Melissa Hunter-Ensor; Nicholas R. Ballor

(57) ABSTRACT

The invention features nucleobase editors and multi-effector nucleobase editors having an improved editing profile with
(Continued)

minimal off-target deamination, compositions comprising such editors, and methods of using the same to generate modifications in target nucleobase sequences.

27 Claims, 85 Drawing Sheets

Specification includes a Sequence Listing.

Related U.S. Application Data filed on Apr. 17, 2019, provisional application No. 62/799,702, filed on Jan. 31, 2019.

(51) Int. Cl.
*C12N 9/80* (2006.01)
*C12N 15/90* (2006.01)

(52) U.S. Cl.
CPC ................ *C12Y 305/04004* (2013.01); *C12Y 305/04005* (2013.01)

(56) References Cited

U.S. PATENT DOCUMENTS

| | | | |
|---|---|---|---|
| 9,322,037 | B2 | 4/2016 | Liu et al. |
| 9,388,430 | B2 | 7/2016 | Liu et al. |
| 9,512,446 | B1 | 12/2016 | Joung et al. |
| 9,737,604 | B2 | 8/2017 | Liu et al. |
| 9,840,699 | B2 | 12/2017 | Liu et al. |
| 10,113,163 | B2 | 10/2018 | Liu et al. |
| 10,167,457 | B2 | 1/2019 | Liu et al. |
| 10,465,176 | B2 | 11/2019 | Liu et al. |
| 10,526,401 | B2 | 1/2020 | Muir et al. |
| 10,682,410 | B2 | 6/2020 | Liu et al. |
| 10,745,677 | B2 | 8/2020 | Maianti et al. |
| 10,912,833 | B2 | 2/2021 | Liu et al. |
| 10,947,530 | B2 | 3/2021 | Liu et al. |
| 11,053,481 | B2 | 7/2021 | Liu et al. |
| 11,124,782 | B2 | 9/2021 | Liu et al. |
| 11,142,550 | B2 | 10/2021 | Muir et al. |
| 11,155,803 | B2 | 10/2021 | Gaudelli et al. |
| 11,193,123 | B2 | 12/2021 | Halperin |
| 11,214,780 | B2 | 1/2022 | Liu et al. |
| 11,268,082 | B2 | 3/2022 | Liu et al. |
| 11,306,324 | B2 | 4/2022 | Liu et al. |
| 11,319,532 | B2 | 5/2022 | Liu et al. |
| 11,479,767 | B2 | 10/2022 | Smith et al. |
| 11,542,496 | B2 | 1/2023 | Liu et al. |
| 11,702,651 | B2 | 7/2023 | Liu et al. |
| 11,732,274 | B2 | 8/2023 | Liu et al. |
| 12,129,478 | B1 | 10/2024 | Chen et al. |
| 12,241,096 | B2 | 3/2025 | Joung et al. |
| 12,312,613 | B2 | 5/2025 | Kleinstiver et al. |
| 2004/0003420 | A1 | 1/2004 | Kuhn et al. |
| 2004/0115184 | A1 | 6/2004 | Smith et al. |
| 2005/0222030 | A1 | 10/2005 | Allison |
| 2011/0104787 | A1 | 5/2011 | Church et al. |
| 2014/0068797 | A1 | 3/2014 | Doudna et al. |
| 2014/0186958 | A1 | 7/2014 | Zhang et al. |
| 2014/0273226 | A1 | 9/2014 | Wu |
| 2014/0273230 | A1 | 9/2014 | Chen et al. |
| 2014/0356956 | A1 | 12/2014 | Church et al. |
| 2015/0071903 | A1 | 3/2015 | Liu et al. |
| 2015/0165054 | A1 | 6/2015 | Liu et al. |
| 2015/0166980 | A1 | 6/2015 | Liu et al. |
| 2015/0166982 | A1 | 6/2015 | Liu et al. |
| 2015/0166984 | A1 | 6/2015 | Liu et al. |
| 2015/0166985 | A1 | 6/2015 | Liu et al. |
| 2015/0344549 | A1 | 12/2015 | Muir et al. |
| 2016/0046961 | A1 | 2/2016 | Jinek et al. |
| 2016/0200779 | A1 | 7/2016 | Liu et al. |
| 2016/0208243 | A1 | 7/2016 | Zhang et al. |
| 2016/0304846 | A1 | 10/2016 | Liu et al. |
| 2016/0355797 | A1 | 12/2016 | Konermann et al. |
| 2017/0121693 | A1* | 5/2017 | Liu .......................... A61P 7/04 |
| 2017/0275648 | A1 | 9/2017 | Barrangou et al. |
| 2018/0002736 | A1 | 1/2018 | O'Connell et al. |
| 2018/0073012 | A1 | 3/2018 | Liu et al. |
| 2018/0170984 | A1 | 6/2018 | Harris et al. |
| 2018/0179503 | A1 | 6/2018 | Maianti et al. |
| 2018/0216095 | A1 | 8/2018 | Thanos et al. |
| 2018/0237787 | A1 | 8/2018 | Maianti et al. |
| 2018/0298421 | A1 | 10/2018 | Carpenter et al. |
| 2018/0312828 | A1 | 11/2018 | Liu et al. |
| 2019/0002875 | A1 | 1/2019 | Cheng et al. |
| 2019/0010471 | A1 | 1/2019 | Zhang et al. |
| 2019/0010481 | A1 | 1/2019 | Joung et al. |
| 2019/0093099 | A1 | 3/2019 | Liu et al. |
| 2019/0225955 | A1 | 7/2019 | Liu et al. |
| 2019/0367891 | A1 | 12/2019 | Liu et al. |
| 2019/0382775 | A1 | 12/2019 | Tan et al. |
| 2020/0063127 | A1 | 2/2020 | Lu et al. |
| 2020/0190493 | A1 | 6/2020 | Liu et al. |
| 2020/0308571 | A1 | 10/2020 | Joung et al. |
| 2020/0399619 | A1 | 12/2020 | Maianti et al. |
| 2021/0130800 | A1* | 5/2021 | Zhang ................. C12N 15/113 |
| 2021/0198330 | A1* | 7/2021 | Liu ..................... A61K 31/713 |
| 2021/0277379 | A1* | 9/2021 | Gaudelli ........ C12Y 305/04004 |
| 2021/0371858 | A1* | 12/2021 | Evans .................. C12N 15/111 |
| 2022/0047637 | A1 | 2/2022 | Lamothe-Dreuzy et al. |
| 2022/0119785 | A1 | 4/2022 | Liu et al. |
| 2022/0133790 | A1* | 5/2022 | Gehrke ............. C07K 14/7051 424/93.71 |
| 2022/0136012 | A1 | 5/2022 | Gaudelli et al. |
| 2022/0169998 | A1 | 6/2022 | Joung et al. |
| 2022/0220462 | A1 | 7/2022 | Liu et al. |
| 2022/0290115 | A1 | 9/2022 | Liu et al. |
| 2022/0290134 | A1 | 9/2022 | Jin et al. |
| 2022/0290164 | A1 | 9/2022 | Ran et al. |
| 2022/0307003 | A1 | 9/2022 | Liu |
| 2023/0108687 | A1 | 4/2023 | Liu et al. |
| 2023/0348883 | A1 | 11/2023 | Liu et al. |
| 2023/0407277 | A1 | 12/2023 | Joung et al. |

FOREIGN PATENT DOCUMENTS

| | | | |
|---|---|---|---|
| CN | 108290933 | A | 7/2018 |
| CN | 108699116 | A | 10/2018 |
| CN | 115427564 | B | 1/2025 |
| CN | 114144519 | B | 3/2025 |
| CN | 116135974 | B | 3/2025 |
| EP | 2877490 | B1 | 9/2018 |
| JP | 2017500035 | A | 1/2017 |
| JP | 6629734 | A2 | 1/2020 |
| KR | 20160050069 | A | 5/2016 |
| WO | 1997025416 | A2 | 7/1997 |
| WO | 2001038547 | A2 | 5/2001 |
| WO | 2002068676 | A2 | 9/2002 |
| WO | 2002103028 | A2 | 12/2002 |
| WO | 2010132092 | A2 | 11/2010 |
| WO | 2011075627 | A1 | 6/2011 |
| WO | 2013045632 | A1 | 4/2013 |
| WO | 2013176772 | A1 | 11/2013 |
| WO | 2013188037 | A2 | 12/2013 |
| WO | 2014004336 | A2 | 1/2014 |
| WO | 2014089290 | A1 | 6/2014 |
| WO | 2014184143 | A1 | 11/2014 |
| WO | 2014184741 | A1 | 11/2014 |
| WO | 2014186686 | A2 | 11/2014 |
| WO | 2015006294 | A2 | 1/2015 |
| WO | 2015021426 | A1 | 2/2015 |
| WO | 2015089277 | A1 | 6/2015 |
| WO | 2015089406 | A1 | 6/2015 |
| WO | 2015090230 | A1 | 6/2015 |
| WO | 2015092024 | A2 | 6/2015 |
| WO | 2015133554 | A1 | 9/2015 |
| WO | 2015142675 | A2 | 9/2015 |
| WO | 2016011210 | A2 | 1/2016 |
| WO | 2016016343 | A1 | 2/2016 |
| WO | 2016061368 | A1 | 4/2016 |
| WO | 2016069910 | A1 | 5/2016 |
| WO | 2016072399 | A1 | 5/2016 |
| WO | 2016073649 | A1 | 5/2016 |

(56) References Cited

FOREIGN PATENT DOCUMENTS

| | | | |
|---|---|---|---|
| WO | 2016075612 | A1 | 5/2016 |
| WO | 2016094304 | A2 | 6/2016 |
| WO | 2016138038 | A1 | 9/2016 |
| WO | 2016142532 | A2 | 9/2016 |
| WO | 2016172727 | A1 | 10/2016 |
| WO | 2016183438 | A1 | 11/2016 |
| WO | 2016196308 | A1 | 12/2016 |
| WO | 2016196388 | A1 | 12/2016 |
| WO | 2016196655 | A1 | 12/2016 |
| WO | 2016205711 | A1 | 12/2016 |
| WO | 2017011721 | A1 | 1/2017 |
| WO | 2017048969 | A1 | 3/2017 |
| WO | 2017049166 | A1 | 3/2017 |
| WO | 2017070632 | A2 | 4/2017 |
| WO | 2017070633 | A2 | 4/2017 |
| WO | 2017079703 | A1 | 5/2017 |
| WO | 2017079705 | A1 | 5/2017 |
| WO | 2017132580 | A2 | 8/2017 |
| WO | 2017180993 | A1 | 10/2017 |
| WO | 2018027036 | A1 | 2/2018 |
| WO | 2018027078 | A1 | 2/2018 |
| WO | 2018085690 | A1 | 5/2018 |
| WO | 2018089664 | A1 | 5/2018 |
| WO | 2018119354 | A1 | 6/2018 |
| WO | 2018119359 | A1 | 6/2018 |
| WO | 2018129129 | A1 | 7/2018 |
| WO | 2018165629 | A1 | 9/2018 |
| WO | 2018176009 | A1 | 9/2018 |
| WO | 2018/218188 | A2 | 11/2018 |
| WO | 2018213726 | A1 | 11/2018 |
| WO | 2019005884 | A1 | 1/2019 |
| WO | 2019005886 | A1 | 1/2019 |
| WO | 2019023680 | A1 | 1/2019 |
| WO | 2019120310 | A1 | 6/2019 |
| WO | 2019139645 | A2 | 7/2019 |
| WO | 2019226953 | A1 | 11/2019 |
| WO | 2020028823 | A1 | 2/2020 |
| WO | 2020041751 | A1 | 2/2020 |
| WO | 2020051561 | A1 | 3/2020 |
| WO | 2020160514 | A1 | 8/2020 |
| WO | 2020160517 | A1 | 8/2020 |
| WO | 2020163396 | A1 | 8/2020 |
| WO | 2020168051 | A1 | 8/2020 |
| WO | 2020168075 | A1 | 8/2020 |
| WO | 2020168088 | A1 | 8/2020 |
| WO | 2020168122 | A1 | 8/2020 |
| WO | 2020168132 | A1 | 8/2020 |
| WO | 2020168133 | A1 | 8/2020 |
| WO | 2020168135 | A1 | 8/2020 |
| WO | 2020214842 | A1 | 10/2020 |
| WO | 2021020884 | A2 | 2/2021 |
| WO | 2021050571 | A1 | 3/2021 |
| WO | 2021055459 | A1 | 3/2021 |
| WO | 2021087182 | A1 | 5/2021 |
| WO | 2021108717 | A2 | 6/2021 |
| WO | 2021158921 | A2 | 8/2021 |
| WO | 2021175288 | A1 | 9/2021 |
| WO | 2021207651 | A2 | 10/2021 |
| WO | 2022008935 | A1 | 1/2022 |
| WO | 2022015969 | A1 | 1/2022 |
| WO | 2022056254 | A2 | 3/2022 |
| WO | 2022056324 | A1 | 3/2022 |
| WO | 2022112404 | A1 | 6/2022 |
| WO | 2022148955 | A1 | 7/2022 |
| WO | 2022150367 | A1 | 7/2022 |
| WO | 2022150372 | A1 | 7/2022 |
| WO | 2022204574 | A1 | 9/2022 |
| WO | 2023279118 | A2 | 1/2023 |
| WO | 2023288304 | A2 | 1/2023 |
| WO | 2023034959 | A2 | 3/2023 |
| WO | 2023047338 | A1 | 3/2023 |
| WO | 2023049299 | A2 | 3/2023 |
| WO | 2023125814 | A1 | 7/2023 |
| WO | 2023155901 | A1 | 8/2023 |
| WO | 2023193536 | A1 | 10/2023 |
| WO | 2023227669 | A3 | 11/2023 |
| WO | 2023247753 | A1 | 12/2023 |
| WO | 2023248110 | A1 | 12/2023 |
| WO | 2024040083 | A1 | 2/2024 |
| WO | 2024063273 | A1 | 3/2024 |
| WO | 2024073385 | A2 | 6/2024 |
| WO | 2024179426 | A2 | 9/2024 |
| WO | 2024226156 | A1 | 10/2024 |
| WO | 2024227047 | A2 | 10/2024 |
| WO | 2024259364 | A2 | 12/2024 |

OTHER PUBLICATIONS

GenBank. "Apobec1 [Pongo Pygmaeus]—Protein—NCBI." Nih.gov, 2019, www.ncbi.nlm.nih.gov/protein/AAT44389.1?report=genbank&log. Accessed Apr. 25, 2025. (Year: 2019).*

Kim, Y., Komor, A., Levy, J. et al. Increasing the genome-targeting scope and precision of base editing with engineered Cas9-cytidine deaminase fusions. Nat Biotechnol 35, 371-376 (2017). https://doi.org/10.1038/nbt.3803 (Year: 2017).*

Kim et al. (2017), Supplementary Information. (Year: 2017).*

NCBI GenPept. "C->U-Editing Enzyme APOBEC-1 Isoform X2 [Pan Troglodytes] NCBI Reference Sequence: XP_024204018.1." NCBI GenPept, Mar. 20, 2018, www.ncbi.nlm.nih.gov/protein/1367162674?sat=54&satkey=3052571. (Year: 2018).*

Baños-Sanz et al., "Crystal structure and functional insights into uracil-DNA glycosylase inhibition by phage ϕ29 DNA mimic protein p56," Nucleic Acids Research, 2013, vol. 41, No. 13, pp. 6761-6773.

Doudna, Jennifer A., "The Promise and Challenge of Therapeutic Genome Editing," Nature, Feb. 2020, vol. 578, Article No. 7794, pp. 229-236 and pp. 20-24 containing Figures (24 total pages).

Fagagna et al., "The Gam protein of bacteriophage Mu is an orthologue of eukaryotic Ku," EMBO reports, 2003, vol. 4, No. 1, pp. 47-52.

GenBank Accession No. AIT42264.1, downloaded Jan. 9, 2024.

GenBank Accession No. AKA60242.1, downloaded Jan. 9, 2024.

GenBank Accession No. AKQ21048.1, downloaded Jan. 9, 2024.

GenBank Accession No. AKS40380.1, downloaded Jan. 9, 2024.

GenBank Protein No. 4UN5_B, downloaded Jan. 9, 2024.

Hendel et al., "Chemically modified guide RNAs enhance CRISPR-Cas genome editing in human primary cells," Nature Biotechnology, Sep. 2015, vol. 33, Article No. 9, pp. 985-989 and pp. 13-14 containing Figures (14 total pages).

Kim et al., "Increasing the genome-targeting scope and precision of base editing with engineered Cas9-cytidine deaminase fusions," Nature Biotechnology, Apr. 2017, vol. 35, Article No. 4, pp. 371-376 and pp. 377-385 containing Online Methods, Supplementary Material, Acknowledgments, References and Figures (15 total pages).

Lin et al., "[Construction and evaluation of DnaB split intein high expression vector and a six amino acids cyclic peptide library]," Chinese Journal of Biotechnology, Nov. 1, 2008, vol. 24, No. 11, pp. 1924-1930 [English Abstract Only].

Micozzi et al., "Human cytidine deaminase: A biochemical characterization of its naturally occurring variants," International Journal of Biological Macromolecules, Feb. 2014, vol. 63, pp. 64-74 and pp. 75-91 containing Acknowledgments, Abbreviations, References, and Figures (28 total pages).

NCBI Reference Protein No. Q694B3.2, downloaded Apr. 8, 2024.

NCBI Reference Sequence No. NC_000001.11, downloaded Jan. 9, 2024.

NCBI Reference Sequence No. WP_002989955.1, downloaded Jan. 9, 2024.

NCBI Reference Sequence No. WP_010922251.1, downloaded Jan. 9, 2024.

NCBI Reference Sequence No. WP_011054416.1, downloaded Jan. 9, 2024.

NCBI Reference Sequence No. WP_011284745.1, downloaded Jan. 9, 2024.

NCBI Reference Sequence No. WP_011285506.1, downloaded Jan. 9, 2024.

(56) References Cited

OTHER PUBLICATIONS

NCBI Reference Sequence No. WP_011527619.1, downloaded Jan. 9, 2024.
NCBI Reference Sequence No. WP_012560673.1, downloaded Jan. 9, 2024.
NCBI Reference Sequence No. WP_014407541.1, downloaded Jan. 9, 2024.
NCBI Reference Sequence No. WP_020905136.1, downloaded Jan. 9, 2024.
NCBI Reference Sequence No. WP_023080005.1, downloaded Jan. 9, 2024.
NCBI Reference Sequence No. WP_023610282.1, downloaded Jan. 9, 2024.
NCBI Reference Sequence No. WP_030125963.1, downloaded Jan. 9, 2024.
NCBI Reference Sequence No. WP_030126706.1, downloaded Jan. 9, 2024.
NCBI Reference Sequence No. WP_031488318.1, downloaded Jan. 9, 2024.
NCBI Reference Sequence No. WP_032460140.1, downloaded Jan. 9, 2024.
NCBI Reference Sequence No. WP_032461047.1, downloaded Jan. 9, 2024.
NCBI Reference Sequence No. WP_032462016.1, downloaded Jan. 9, 2024.
NCBI Reference Sequence No. WP_032462936.1, downloaded Jan. 9, 2024.
NCBI Reference Sequence No. WP_032464890.1, downloaded Jan. 9, 2024.
NCBI Reference Sequence No. WP_038431314.1, downloaded Jan. 9, 2024.
NCBI Reference Sequence No. WP_038432938.1, downloaded Jan. 9, 2024.
NCBI Reference Sequence No. WP_038434062.1, downloaded Jan. 9, 2024.
NCBI Reference Sequence No. WP_048327215.1, downloaded Jan. 9, 2024.
NCBI Reference Sequence No. WP_049519324.1, downloaded Jan. 9, 2024.
Ramakrishna et al., "Gene disruption by cell-penetrating peptide-mediated delivery of Cas9 protein and guide RNA," Genome Research, 2014, vol. 24, pp. 1020-1027.
Ribeiro et al., "Protein Engineering Strategies to Expand CRISPR-Cas9 Applications," Hindawi: International Journal of Genomics, 2018, vol. 2018, Article No. 1652567, pp. 1-12.
Rogozin et al. "Evolution and diversification of lamprey antigen receptors: evidence for involvement of an AID-APOBEC family cytosine deaminase," Nature Immunology, Jun. 2007, vol. 8, No. 6, pp. 647-656.
Sang et al., "A unique uracil-DNA binding protein of the uracil DNA glycosylase superfamily," Nucleic Acids Research, Sep. 30, 2015, vol. 43, No. 17, pp. 8452-8463.
Shee et al., "Engineered proteins detect spontaneous DNA breakage in human and bacterial cells," eLife, 2013, vol. 2, No. e01222, pp. 1-25.
UniProt Accession No. P51908, Downloaded Jan. 9, 2024.
Yang et al., "APOBEC: From mutator to editor," Journal of Genetics and Genomics, 2017, vol. 44, pp. 423-437.
Zong et al., "Precise base editing in rice, wheat and maize with a Cas9-cytidine deaminase fusion," Nature Biotechnology, 2017, pp. 1-4.
Cartegni et al., "Determinants of Exon 7 Splicing in the Spinal Muscular Atrophy Genes, SMN1 and SMN2," The American Journal of Human Genetics, Jan. 2006, vol. 78, pp. 63-77.
Chang et al., "Degradation of survival motor neuron (SMN) protein is mediated via the ubiquitin/proteasome pathway," Neurochemistry International, 2004, vol. 45, pp. 1107-1112.
Charpentier et al. "Rewriting a genome", Nature, Mar. 2013, vol. 495, No. 7439, pp. 50-51.
Chen et al. "Targeting genomic rearrangements in tumor cells through Cas9-mediated insertion of a suicide gene." Nature Biotechnology, Jun. 2017, vol. 35, No. 6, pp. 543-552.
Cho et al., "A degron created by SMN2 exon 7 skipping is a principal contributor to spinal muscular atrophy severity," Genes & Development, 2010, vol. 24, pp. 438-442.
Corcia et al., "The importance of the SMN genes in the genetics of sporadic ALS," Amyotrophic Lateral Sclerosis, 2009, vol. 10, pp. 436-440.
Corti et al., "Genetic Correction of Human Induced Pluripotent Stem Cells from Patients with Spinal Muscular Atrophy," Science Translational Medicine, Dec. 19, 2012, vol. 4, Article No. 165, pp. 1-20 and pp. 21-32 containing Figures (32 total pages).
Cucchiarini et al., "Enhanced expression of the central survival of motor neuron (SMN) protein during the pathogenesis of osteoarthritis," Journal of Cellular and Molecular Medicine, 2014, vol. 18, No. 1, pp. 115-124.
De Souza. "Primer: genome editing with engineered nucleases." Nature Methods, vol. 9, No. 1, Jan. 2012, pp. 27-27.
D'Ydewalle et al., "The Antisense Transcript SMN-AS1 Regulates SMN Expression and is a Novel Therapeutic Target for Spinal Muscular Atrophy," Neuron, Jan. 4, 2017, vol. 93, pp. 63-79.
Grimm et al., In vitro and In vivo Gene Therapy Vector Evolution via Multispecies Interbreeding and Retargeting of Adeno-Associated Viruses. J. Virol., 2008, vol. 82, p. 5887-5911.
Kim et al., "Structural and Kinetic Characterization of *Escherichia coli* TadA, the Wobble-Specific TRNA Deaminase," Biochemistry, 2006, vol. 45, No. 20, pp. 6407-6416.
Kim et al., "Highly efficient RNA-guided base editing in mouse embryos," Nature Biotechnology, 2017, pp. 1-4.
Kleinstiver et al., "Engineered CRISPR-Cas9 nucleases with altered PAM specificities," Nature, Jul. 23, 2015, vol. 523, Article No. 7561, pp. 481-485 and pp. 24-27 containing Figures (27 total pages).
Lau et al., "Molecular basis for discriminating between normal and damaged bases by the human alkyladenine glycosylase, AAG," Proceedings of the National Academy of Sciences of the United States of America, Dec. 5, 2000, vol. 97, No. 25, pp. 13573-13578.
Le et al., "SMND7, the major product of the centromeric survival motor neuron (SMN2 ) gene, extends survival in mice with spinal muscular atrophy and associates with full-length SMN," Human Molecular Genetics, 2005, vol. 14, No. 6, pp. 845-857.
Lefebvre et al., "Identification and Characterization of a Spinal Muscular Atrophy-Determining Gene," Jan. 13, 1995, vol. 80, pp. 155-165.
Li et al. "Base editing with a Cpf1-cytidine deaminase fusion." Nature biotechnology, 2018, vol. 36, No. 4, pp. 324-327.
Liu et al., "Research Progress of Base Editing System," World Sci-Tech R&D, Dec. 2017, vol. 39, No. 6, pp. 457-462 [English Abstract].
Liu, et al. "Crossing the blood-brain barrier with AAV vectors," Metabolic Brain Disease, 2021, vol. 36, pp. 45-52.
Lorson et al., "A single nucleotide in the SMN gene regulates splicing and is responsible for spinal muscular atrophy," Proceedings of the National Academy of Sciences of the United States of America, May 1999, vol. 96, pp. 6307-6311.
Lutz et al., "Postsymptomatic restoration of SMN rescues the disease phenotype in a mouse model of severe spinal muscular atrophy," The Journal of Clinical Investigation, Aug. 2011, vol. 121, No. 8, pp. 3029-3041.
Lyons et al., "Efficient Recognition of an Unpaired Lesion by a DNA Repair Glycosylase," Journal of the American Chemical Society, 2009, vol. 131, No. 49, pp. 17742-17743.
Maeder et al. "CRISPR RNA-guided activation of endogenous human genes", Nature Methods, Oct. 2013, vol. 10, No. 10, pp. 977-979.
Mariani et al. "Species-specific exclusion of APOBEC3G from HIV-1 virions by Vif." Cell, 2003, vol. 114, No. 1, 21-31.
Monani et al., "A single nucleotide difference that alters splicing patterns distinguishes the SMA gene SMN1 from the copy gene SMN2," Human Molecular Genetics, 1999, vol. 8, No. 7, pp. 1177-1183.

(56) References Cited

OTHER PUBLICATIONS

Murray et al., "Selective vulnerability of motor neurons and dissociation of pre- and post-synaptic pathology at the neuromuscular junction in mouse models of spinal muscular atrophy," Human Molecular Genetics, 2008, vol. 17, No. 7, pp. 949-962.
Nelson et al., "In vivo genome editing improves muscle function in a mouse model of Duchenne muscular dystrophy," Science, Jan. 22, 2016, vol. 351, No. 6271, pp. 403-407.
O'Connell et al., Programmable RNA recognition and cleavage by CRISPR/Cas9. Nature, 2014, vol. 516, p. 263-266.
Ousterout et al., "Multiplex CRISPR/Cas9-based genome editing for correction of dystrophin mutations that cause Duchenne muscular dystrophy," Nature Communications, Feb. 2015, vol. 6, No. 6244, pp. 1-13.
Pattanayak et al., "High-throughput profiling of off-target DNA cleavage reveals RNA-programmed Cas9 nuclease specificity," Nature Biotechnology, Sep. 2013, vol. 31, No. 9, pp. 839-843.
Ranzau et al., "The wild-type tRNA adenosine deaminase enzyme TadA is capable of sequence-specific DNA base editing." Chembiochem, Aug. 2023, vol. 24, No. 16, pp. 1-35.
Riesenberg et al. "Improved gRNA secondary structures allow editing of target sites resistant to CRISPR-Cas9 cleavage." Nature communications, 2022, vol. 13 No. 1, pp. 489.
Ruffolo, et al., "Design of highly functional genome editors by modeling of the universe of CRISPR-Cas Sequences," bioRxiv, posted Apr. 22, 2024, doi: 10.1101/2024.04.22.590591.
Schrank et al., "Inactivation of the survival motor neuron gene, a candidate gene for human spinal muscular atrophy, leads to massive cell death in early mouse embryos," Proceedings of the National Academy of Sciences of the United States of America, Sep. 1997, vol. 94, pp. 9920-9925.
Singh et al., "Splicing of a Critical Exon of Human Survival Motor Neuron is Regulated by a Unique Silencer Element Located in the Last Intron," Molecular and Cellular Biology, Feb. 2006, vol. 26, No. 4, pp. 1333-1346.
Song et al. "Delivery of CRISPR/Cas systems for cancer gene therapy and immunotherapy." Advanced Drug Delivery Reviews, 2021, vol. 168, pp. 150-180.
Stanton et al. "Systemic administration of novel engineered AAV capsids facilitates enhanced transgene expression in the macaque CNS." Med, 2023, vol. 4. No. 1, pp. 31-50.
Talbot et al., "Spinal muscular atrophy," Journal of Inherited Metabolic Disease, Jun. 2001, vol. 21, No. 2, pp. 189-197 [Abstract Only].
Thorpe et al. "Functional Correction of Episomal Mutations With Short DNA Fragments and RNA-DNA Oligonucleotides." Journal of Gene Medicine, Jan. 2002, vol. 4, No. 1, pp. 195-204.
Tipanee, et al. "Transposons: Moving Forward from Preclinical Studies to Clinical Trials," Human Gene Therapy, Nov. 2017, pp. 1087-1104.
Tsai et al. "Dimeric CRISPR RNA-guided FokI nucleases for highly specific genome editing." Nature Biotechnology, Apr. 2014, vol. 32, No. 6, pp. 569-576.
UniProt Accession No. Q6JC40, Downloaded Nov. 14, 2024.
Wan et al. "Material solutions for delivery of CRISPR/Cas-based genome editing tools: current status and future outlook." Materials Today, Jun. 2019, vol. 26, pp. 40-66.
Wirth et al., "Mildly affected patients with spinal muscular atrophy are partially protected by an increased SMN2 copy number," Human Genetics, 2006, vol. 119, pp. 422-428.
Wolf et al., "tadA, an essential tRNA-specific adenosine deaminase from *Escherichia coli*," The EMBO Journal, 2002, vol. 21, No. 14, pp. 3841-3851.
Zheng et al., "DNA Editing in DNA/RNA Hybrids by Adenosine Deaminases That Act on RNA," Nucleic Acids Research, 2017, vol. 45, No. 6, pp. 3369-3377.
Zhou et al., "Cas12a variants designed for lower genome-wide off-target effect through stringent PAM recognition", Molecular Therapy, Jan. 2022, vol. 30, No. 1 , pp. 1-12.
Walton et al., "Unconstrained genome targeting with near-PAMless engineered CRISPR-Cas9 variants," Science, Mar. 26, 2020, pp. 1-11.
Wang et al., "Enhanced base editing by co-expression of free uracil DNA glycosylase inhibitor," Cell research, Oct. 2017, vol. 27, No. 10, pp. 1289-1292.
Wang et al., "Eliminating base-editor-induced genome-wide and transcriptome-wide off-target mutations," Nature Cell Biology, 2021, pp. 1-32.
Wijesinghe et al., "Efficient deamination of 5-methylcytosines in DNA by human APOBEC3A, but not by AID or APOBEC3G," Nucleic Acids Research, Jul. 13, 2012, vol. 40, No. 18, pp. 9206-9217.
Yan et al., "Functionally diverse type V CRISPR-Cas systems," Science, Jan. 4, 2019, vol. 363, pp. 88-91.
Yang et al., "Engineering and optimising deaminase fusions for genome editing," Nature Communications, 2016, vol. 7, No. 13330, pp. 1-11.
Yang et al., "Increasing targeting scope of adenosine base editors in mouse and rat embryos through fusion of TadA deaminase with Cas9 variants," Protein & Cell, 2018, vol. 9, No. 9, pp. 814-819.
Yang et al., "PAM-Dependent Target DNA Recognition and Cleavage by C2c1 CRISPR-Cas Endonuclease," Cell, Dec. 15, 2016, vol. 167, pp. 1814-1828.
Yeh et al., "In vivo base editing of post-mitotic sensory cells," Nature Communications, 2018, vol. 9, No. 2184, pp. 1-10.
Yu et al., "Cytosine base editors with minimized unguided DNA and RNA off-target events and high on-target activity," Nature Communications, 2020, vol. 11, No. 2052, pp. 1-10.
Zafra et al., "Optimized base editors enable efficient editing in cells, organoids and mice," Nature Biotechnology, 2018, pp. 1-6.
Zhou et al., "Atypical behaviour and connectivity in SHANK3-mutant macaques," Nature, Jun. 20, 2019, vol. 570, pp. 326-331.
Zhou et al., "Off-target RNA mutation induced by DNA base editing and its elimination by mutagenesis," Nature, Jul. 11, 2019, vol. 571, pp. 275-277.
Zuo et al., "Cytosine base editor generates substantial off-target singlenucleotide variants in mouse embryos," Science, vol. Apr. 19, 2019, vol. 364, No. 6437, pp. 289-292.
Zuris et al., "Efficient Delivery of Genome-Editing Proteins In Vitro and In Vivo," Nature Biotechnology, Jan. 2015, vol. 33, No. 1, pp. 73-80.
Burstein et al., "New CRISPR-Cas systems from uncultivated microbes," Howard Hughes Medical Institute, Feb. 9, 2017, vol. 542, No. 7640, pp. 237-241.
Cheng et al., "Cloning, expression and activity identification of human innate immune protein apolipoprotein B mRNA editing enzyme catalytic subunit 3A(APOBEC3A)," Chinese Journal of Cellular and Molecular Immunology, 2017, vol. 33, No. 2, pp. 179-184 [English Abstract].
Ekstrand et al., "Frequent alterations of the PI3K/AKT/mTOR pathways in hereditary nonpolyposis colorectal cancer," Familial Cancer, 2010, vol. 9, pp. 125-129.
Kaya et al., "A bacterial Argonaute with noncanonical guide RNA specificity," Proceedings of the National Academy of Sciences of the United States of America, Apr. 12, 2016, vol. 113, No. 15, pp. 4057-4062.
Komor et al., "CRISPR-Based Technologies for the Manipulation of Eukaryotic Genomes," Cell, Jan. 12, 2017, vol. 168, pp. 20-36.
Kury et al., "De Novo Disruption of the Proteasome Regulatory Subunit PSMD12 Causes a Syndromic Neurodevelopmental Disorder," The American Journal of Human Genetics, Feb. 2, 2017, vol. 100, pp. 352-363.
Lavergne et al., "Defects in type IIA von Willebrand disease: a cysteine 509 to arginine substitution in the mature von Willebrand factor disrupts a disulphide loop involved in the interaction with platelet glycoprotein Ib-IX," British Journal of Haematology, 1992, vol. 82, pp. 66-72.
Plosky, Brian S., "CRISPR-Mediated Base Editing without DNA Double-Strand Breaks," Molecular Cell, May 19, 2016, vol. 62, pp. 477-478.

(56) References Cited

OTHER PUBLICATIONS

Kleinstiver et al., "Broadening *Staphylococcus aureus* Cas9 Targeting Range by Modifying PAM Recognition," Nature Biotechnology, Dec. 2015, vol. 33, No. 12, pp. 1293-1298.
Kleinstiver et al., "Engineered CRISPR-Cas9 nucleases with altered PAM specificities," Nature, Jul. 23, 2015, vol. 523, pp. 481-485.
Kleinstiver et al., "High-fidelity CRISPR-Cas9 variants with undetectable genome-wide off-targets," Molecular Therapy, Jan. 28, 2016, vol. 529, No. 75187, pp. 490-495.
Koblan et al., "Improving cytidine and adenine base editors by expression optimization and ancestral reconstruction," Nature Biotechnology, 2018, pp. 1-4.
Komor et al., "Improved base excision repair inhibition and bacteriophage Mu Gam protein yields C:G-to-T:A base editors with higher efficiency and product purity," Science Advances, Aug. 30, 2017, vol. 3, No. eaao4774, pp. 1-9.
Komor et al., "Programmable editing of a target base in genomic DNA without double-stranded DNA cleavage," Nature, May 19, 2016, vol. 533, pp. 420-424.
Kundu et al., "Leucine to proline substitution by SNP at position 197 in Caspase-9 gene expression leads to neuroblastoma: a bioinformatics analysis," 3 Biotech, 2013, vol. 3, pp. 225-234.
Lapinaite et al., "DNA capture by a CRISPR-Cas9-guided adenine base editor," Science, Jul. 31, 2020, vol. 369, No. 6503, pp. 566-571.
Lazar et al., "Transforming Growth Factor α: Mutation of Aspartic Acid 47 and Leucine 48 Results in Different Biological Activities," Molecular and Cellular Biology, Mar. 1988, vol. 8, No. 3, pp. 1247-1252.
Lee et al., "CRISPR-Pass: Gene Rescue of Nonsense Mutations Using Adenine Base Editors," Molecular Therapy, Aug. 2019, vol. 27, No. 8, pp. 1364-1371.
Lee et al., "Cytosine but not adenine base editor generates mutations in mice," bioRxiv, 2019, pp. 1-24.
Lee et al., "PIK3CA gene is frequently mutated in breast carcinomas and hepatocellular carcinomas," Oncogene, 2005, vol. 24, pp. 1477-1480.
Lenk et al., "Pathogenic Mechanism of the FIG4 Mutation Responsible for Charcot-Marie-Tooth Disease CMT4J," PLoS Genetics, Jun. 2011, vol. 7, No. 6, e1002104, pp. 1-13.
Li et al., "Current Approaches for Engineering Proteins with Diverse Biological Properties," Bio-Applications of Nanoparticles, 2007, pp. 1-16.
Liu et al., "C2c1-sgRNA Complex Structure Reveals RNA-Guided DNA Cleavage Mechanism," Molecular Cell, Jan. 19, 2017, vol. 65, pp. 310-322.
Ma et al., "Targeted AID-mediated mutagenesis (TAM) enables efficient genomic diversification in mammalian cells," Nature Methods, Dec. 2016, vol. 13, No. 12, pp. 1029-1035.
Makarova et al., "Classification and Nomenclature of CRISPR-Cas Systems: Where from Here?," The CRISPR Journal, 2018, vol. 1, No. 5, pp. 325-336.
Mali et al., "Cas9 as a versatile tool for engineering biology," Nature Methods, Oct. 2013, vol. 10, No. 10, pp. 957-963.
Mali et al., "CAS9 transcriptional activators for target specificity screening and paired nickases for cooperative genome engineering," Nature Biotechnology, 2013, pp. 1-6.
Mccann et al., "MagnEdit—interacting factors that recruit DNA-editing enzymes to single base targets," Life Science Alliance, 2020, vol. 3, No. 4, e201900606, pp. 1-9.
Mikami et al., "Comparison of CRISPR/Cas9 expression constructs for efficient targeted mutagenesis in rice," Plant Molecular Biology, 2015, vol. 88, pp. 561-572.
Miller et al., "Continuous evolution of SpCas9 variants compatible with non-G PAMs," Nature Biotechnology, Apr. 2020, vol. 38, No. 4, pp. 471-481.
Mohamad et al., "Human hemoglobin G-Makassar variant masquerading as sickle cell anemia," Hematology Reports, 2018, vol. 10, No. 7210, pp. 92-95.
Mullins et al., "Transgenesis in Nonmurine Species," Hypertension, Oct. 1993, vol. 22, No. 4, pp. 630-633.
Navaratnam et al., "An Overview of Cytidine Deaminases," International Journal of Hematology, 2006, vol. 83, pp. 195-200.
Nishida et al., "Targeted nucleotide editing using hybrid prokaryotic and vertebrate adaptive immune systems," Science, Sep. 16, 2016, vol. 353, No. 6305, pp. 1248-aaf8729-8.
Nishimasu et al., "Engineered CRISPR-Cas9 nuclease with expanded targeting space," Science, 2018, vol. 361, pp. 1259-1262.
Okumura et al., "Evolutionary paths of streptococcal and staphylococcal superantigens," BMC Genomics, 2012, vol. 13, No. 404, pp. 1-16.
Parr et al., "N1-Methylpseudouridine substitution enhances the performance of synthetic mRNA switches in cells," Nucleic Acids Research, 2020, vol. 48, No. 6, e35, pp. 1-9.
Pausch et al., "CRISPR-Caso from huge phages is a hypercompact genome editor," Science, Jul. 17, 2020, vol. 369, No. 6501, pp. 333-337.
Phillips, Anthony J., "The challenge of gene therapy and DNA delivery," Journal of Pharmacy and Pharmacology, 2001, vol. 53, pp. 1169-1174.
Poller et al., "A Leucine-to-Proline Substitution Causes a Defective α1-Antichymotrypsin Allele Associated with Familial Obstructive Lung Disease," Genomics, 1993, vol. 17, pp. 740-743.
Putnam et al., "Protein Mimicry of DNA from Crystal Structures of the Uracil-DNA Glycosylase Inhibitor Protein and ts Complex with *Escherichia coli* Uracil-DNA Glycosylase," Journal of Molecular Biology, 1999, vol. 287, pp. 331-346.
Qi et al., "Repurposing CRISPR as an RNA-Guided Platform for Sequence-Specific Control of Gene Expression," Cell, Feb. 28, 2013, vol. 152, pp. 1173-1183.
Ran et al., "In vivo genome editing using *Staphylococcus aureus* Cas9," Nature, Apr. 9, 2015, vol. 520, No. 7546, pp. 186-191.
Rees et al., "Analysis and minimization of cellular RNA editing by DNA adenine base editors," Science Advances, May 8, 2019, vol. 5, No. eaax5717, pp. 1-10.
Rees et al., "Base editing: precision chemistry on the genome and transcriptome of living cells," Nature Reviews Genetics, Dec. 2018, vol. 19, No. 12, pp. 770-788.
Rees et al., "Improving the DNA specificity and applicability of base editing through protein engineering and protein delivery," Nature Communications, 2017, vol. 8, No. 15790, pp. 1-10.
Richter et al., "Phage-assisted evolution of an adenine base editor with improved Cas domain compatibility and activity," Nature Biotechnology, Jul. 2020, vol. 38, No. 7, pp. 883-891.
Sang, Helen, "Prospects for transgenesis in the chick," Mechanisms of Development, 2004, vol. 121, pp. 1179-1186.
Shimomura et al., "Complete genome sequencing and analysis of a Lancefield group G *Streptococcus dysgalactiae* subsp. equisimilis strain causing streptococcal toxic shock syndrome (STSS)," BMC Genomics, 2011, vol. 12, No. 17, pp. 1-17.
Shmakov et al., "Discovery and Functional Characterization of Diverse Class 2 CRISPR-Cas Systems," Molecular Cell, Nov. 5, 2015, vol. 60, pp. 385-397.
Slaymaker et al., "Rationally engineered Cas9 nucleases with improved specificity," Science, Jan. 1, 2016, vol. 351, No. 6268, pp. 84-88.
Tan et al., "Engineering of high-precision base editors for site-specific single nucleotide replacement," Nature Communications, 2019, vol. 10, No. 439, pp. 1-10.
Tanenbaum et al., "A Protein-Tagging System for Signal Amplification in Gene Expression and Fluorescence Imaging," Cell, Oct. 23, 2014, vol. 159, pp. 635-646.
Tsai et al., "GUIDE-seq enables genome-wide profiling of off-target cleavage by CRISPR-Cas nucleases," Nature Biotechnology, Feb. 2015, vol. 33, No. 2, pp. 187-197.
UniProt Accession No. P01011, Create Date Jul. 21, 1986.
UniProt Accession No. Q99ZW2, Create Date Jul. 11, 2012.
UniProt Proteome ID No. UP000009215, Create Date May 2012.
Wacey et al., "Disentangling the perturbational effects of amino acid substitutions in the DNA-binding domain of p53," Human Genetics, 1999, vol. 104, pp. 15-22.
Addgene Plasmid No. 44246, Create Date Feb. 28, 2013.

(56) References Cited

OTHER PUBLICATIONS

Addgene Plasmid No. 73021, Create Date Apr. 20, 2016.
Addgene Plasmid No. 79620, Create Date Aug. 4, 2016.
Alexandrov et al., "Signatures of mutational processes in human cancer," Nature, Aug. 22, 2013, vol. 500, pp. 415-421.
Andries et al., "N1-methylpseudouridine-incorporated mRNA outperforms pseudouridine-incorporated mRNA by providing enhanced protein expression and reduced immunogenicity in mammalian cell lines and mice," Journal of Controlled Release, 2015, vol. 217, pp. 337-344.
Bae et al., "Cas-OFFinder: a fast and versatile algorithm that searches for potential off-target sites of Cas9 RNA-guided endonucleases," Bioinformatics, Jan. 24, 2014, vol. 30, No. 10, pp. 1473-1475.
Billon et al., "CRISPR-Mediated Base Editing Enables Efficient Disruption of Eukaryotic Genes through Induction of STOP Codons," Molecular Cell, Sep. 21, 2017, vol. 67, pp. 1068-1079.
Branden and Tooze, "The Building Blocks," Introduction to Protein Structure, 1999, vol. 2, pp. 3-12.
Briner et al., "Guide RNA Functional Modules Direct Cas9 Activity and Orthogonality," Molecular Cell, Oct. 23, 2014, vol. 56, pp. 333-339.
Bulow et al., "Multienzyme systems obtained by gene fusion," Trends in Biotechnology, Jan. 1991, vol. 9, pp. 226-231.
Cameron, Ewan R., "Recent Advances in Transgenic Technology," Molecular Biotechnology, 1997, vol. 7, pp. 253-265.
Chatterjee et al., "A Cas9 with PAM recognition for adenine dinucleotides," Nature Communications, 2020, vol. 11, No. 2474, pp. 1-6.
Chichili et al., "Linkers in the structural biology of protein-protein interactions," Protein Science, 2013, vol. 22, pp. 153-167.
Chylinski et al., "The tracrRNA and Cas9 families of type II CRISPR-Cas immunity systems," RNA Biology, May 2013, vol. 10, No. 5, pp. 726-737.
Collantes et al., "Development and Characterization of a Modular CRISPR and RNA Aptamer Mediated Base Editing System," The CRISPR Journal, 2021, vol. 4, No. 1, pp. 58-68.
Cong et al., "Multiplex Genome Engineering Using CRISPR/Cas Systems," Science, Feb. 15, 2013, vol. 339, No. 6121, pp. 819-823.
Deltcheva et al., "CRISPR RNA maturation by trans-encoded small RNA and host factor RNase III," Nature, Mar. 31, 2011, vol. 471, pp. 602-607.
Endo et al., "Toward establishing an efficient and versatile gene targeting system in higher plants," Biocatalysis and Agricultural Biotechnology, 2014, vol. 3, pp. 2-6.
Ferretti et al., "Complete genome sequence of an M1 strain of *Streptococcus pyogenes*," Proceedings of the National Academy of Sciences of the United States of America, Apr. 10, 2001, vol. 98, No. 8, pp. 4658-4663.
Fonfara et al., "Phylogeny of Cas9 determines functional exchangeability of dual-RNA and Cas9 among orthologous type II CRISPR-Cas systems," Nucleic Acids Research, 2014, vol. 42, No. 4, pp. 2577-2590.
Freshney et al., "Culture of Animal Cells, A Manual of Basic Technique," Food and Chemical Toxicology, 1983, vol. 23, No. 3, pp. 403-404.
Fu et al., "Human cell based directed evolution of adenine base editors with improved efficiency," Nature Communications, 2021, vol. 12, No. 5897, pp. 1-11.
Gardlik et al., "Vectors and delivery systems in gene therapy," Medical Science Monitor, 2005, vol. 11, No. 4, pp. RA110-RA121.
Gasiunas et al., "Cas9-crRNA ribonucleoprotein complex mediates specific DNA cleavage for adaptive immunity in bacteria," Proceedings of the National Academy of Sciences of the United States of America, Sep. 4, 2012, pp. E2579-E2586.
Gasiunas et al., "RNA-dependent DNA endonuclease Cas9 of the CRISPR system: Holy Grail of genome editing?" Trends in Microbiology, Nov. 2013, vol. 21, No. 11, pp. 562-567.
Gaudelli et al., "Directed evolution of adenine base editors with increased activity and therapeutic application," Nature Biotechnology, 2020, pp. 1-15.
Gaudelli et al., "Programmable base editing of A•T to G•C in genomic DNA without DNA cleavage," Nature, Nov. 23, 2017, vol. 551, pp. 464-471.
Grunewald et al., "CRISPR DNA base editors with reduced RNA off-target and self-editing activities," Nature Biotechnology, Sep. 2019, vol. 37, No. 9, pp. 1041-1048.
Grunewald et al., "Transcriptome-wide off-target RNA editing induced by CRISPR-guided DNA base editors," Nature, May 2019, vol. 569, No. 7756, pp. 433-437.
Guilinger et al., "Fusion of catalytically inactive Cas9 to FokI nuclease improves the specificity of genome modification," Nature Biotechnology, 2014, pp. 1-6.
Guo et al., "Protein tolerance to random amino acid change," Proceedings of the National Academy of Sciences of the United States of America, Jun. 22, 2004, vol. 101, No. 25, pp. 9205-9210.
Hill et al., "Functional Analysis of Conserved Histidines in ADP-Glucose Pyrophosphorylase from *Escherichia coli*," Biochemical Biophysical Research Communications, 1998, vol. 244, No. 2, pp. 573-577.
Houdebine, Louis-Marie, "The methods to generate transgenic animals and to control transgene expression," Journal of Biotechnology, 2002, vol. 98, pp. 145-160.
Hu et al., "Evolved Cas9 variants with broad PAM compatibility and high DNA specificity," Nature, Apr. 5, 2018, vol. 556, pp. 57-63.
Hua et al., "Expanding the base editing scope in rice by using Cas9 variants," Plant Biotechnology Journal, 2019, vol. 17, pp. 499-504.
Huang et al., "Circularly permuted and PAM-modified Cas9 variants broaden the targeting scope of base editors," Nature Biotechnology, Jun. 2019, vol. 37, No. 6, pp. 626-631.
Huang et al., "DNA epigenome editing using CRISPR-Cas SunTag-directed DNMT3A," Genome Biology, 2017, vol. 18, No. 176, pp. 1-11.
Jeong et al., "Adenine base editor engineering reduces editing of bystander cytosines," Nature Biotechnology, 2021, pp. 1-12.
Jeong et al., "Precise adenine base editors that exhibit minimized cytosine catalysis," Research Square, 2020, pp. 1-15.
Jiang et al., "Chemical modifications of adenine base editor mRNA and guide RNA expand its application scope," Nature Communications, 2020, vol. 11, No. 1979, pp. 1-9.
Jin et al., "Cytosine, but not adenine, base editors induce genome-wide off-target mutations in rice," Science, Apr. 19, 2019, vol. 364, pp. 292-295.
Jinek et al., "A Programmable Dual-RNA-Guided DNA Endonuclease in Adaptive Bacterial Immunity," Science, Aug. 17, 2012, vol. 337, No. 6096, pp. 816-821.
Jinek et al., "RNA-programmed genome editing in human cells," eLife, 2013, vol. 2, No. e00471, pp. 1-9.
Jore et al., "Structural basis for CRISPR RNA-guided DNA recognition by Cascade," Nature Structural & Molecular Biology, May 2011, vol. 18, No. 5, pp. 529-537.
Kappel et al., "Regulating gene expression in transgenic animals," Current Opinion in Biotechnology, 1992, vol. 3, pp. 548-553.
Kim et al., "Adenine base editors catalyze cytosine conversions in human cells," Nature Biotechnology, Oct. 2019, vol. 37, pp. 1145-1148.
Kim et al., "Highly efficient RNA-guided genome editing in human cells via delivery of purified Cas9 ribonucleoproteins," Genome Research, 2014, vol. 24, pp. 1012-1019.
Kim et al., "Rescue of high-specificity Cas9 variants using sgRNAs with matched 5' nucleotides," Genome Biology, 2017, vol. 18, No. 218, pp. 1-6.
Kim et al., "Transcriptional Repression by Zinc Finger Peptides," The Journal of Biological Chemistry, Nov. 21, 1997, vol. 272, No. 47, pp. 29795-29800.
Kitamura et al., "Uracil DNA Glycosylase Counteracts APOBEC3G-Induced Hypermutation of Hepatitis B Viral Genomes: Excision Repair of Covalently Closed Circular DNA," PLOS Pathogens, May 2013, vol. 9, No. 5, e1003361, pp. 1-14.

(56) References Cited

OTHER PUBLICATIONS

Burgess et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," The Journal of Cell Biology, Nov. 1990, vol. 111, pp. 2129-2138.
Cofsky et al., "CRISPR-Cas9 bends and twists DNA to read its sequence," Nat Struct Mol Biol, Apr. 2022, vol. 29, No. 4, pp. 395-402.
Lin et al. "Structure-function relations in glucagon. Properties of highly purified Des-his1-, monoiodo-, and [Des-Asn28, Thr29](homoserine lactone27)-glucagon." Biochemistry vol. 14, No. 8, 1975, pp. 1559-1563.
Ma et al., "A new mutation in BFSP2 (G1091A) causes autosomal dominant congenital lamellar cataracts," Molecular Vision, Oct. 2008, vol. 14, pp. 1906-1911.
Schwartz et al., "A superactive insulin: [B10-Aspartic acid]insulin(human)," Proc. Natl. Acad. Sci. USA, Sep. 1987, vol. 84, pp. 6408-6411.
International Search Report and Written Opinion in International Patent Application No. PCT/US2020/016288, mailed Jul. 6, 2020 (14 pages).
Teng, B. et al., Mutational analysis of apolipoprotein B mRNA editing enzyme (APOBEC1): structure-function relationships of RNA editing and dimerization, Journal of Lipid Research, 1999, vol. 40, pp. 623-635.
Chester, A. et al., The apolipoprotein B mRNA editing complex performs a multifunctional cycle and suppresses nonsense-mediated decay, The EMBO Journal, Aug. 1, 2003, vol. 22, No. 15, pp. 3971-3982.
Conticello, "The AID/APOBEC family of nucleic acid mutators." Genome Biology, 2008, vol. 9, No. 229 (10 pages).
Komor et al., "Programmable Editing of a Target Base in Genomic DNA without Double-Stranded DNA Cleavage," Nature, May 19, 2016, vol. 533, pp. 420-424 and pp. 425-436 containing Methods and Figures (25 total pages).
Wang et al., "BE-PIGS: a base-editing tool with deaminases inlaid into Cas9 PI domain significantly expanded the editing scope." Signal Transduction and Targeted Therapy, 2019, vol. 4, No. 36 (3 pages).

* cited by examiner pYY-TSP-A16

| | gC2c | cC3c | cC4a | gC7a | tC12a | aC14t |
|---|---|---|---|---|---|---|
| ppAPOBEC1 R33A K34A | 0.02% | 0.15% | 0.31% | 1.3% | 1.28% | 0.07% |
| ppAPOBEC1 R33A | 0.26% | 0.99% | 1.81% | 10.1% | 17.4% | 0.51% |
| ppAPOBEC1 K34A | 0.1% | 0.36% | 0.79% | 2.91% | 5.69% | 0.26% |
| ppAPOBEC1 H122A | 2.18% | 1.51% | 9.92% | 39.7% | 1.49% | 0.16% |
| hAPOBEC3A Y130A | 0.2% | 0.67% | 10.9% | 23.9% | 0.6% | 7.17% |
| rAPOBEC1 K34A R33A | 0.03% | 0.12% | 0.17% | 0.08% | 0.59% | 0.03% |
| rAPOBEC1 K34A H122A | 0.35% | 5.97% | 15.8% | 13.7% | 0.8% | 0.03% |
| rAPOBEC1 (no Cas9) | 0.03% | 0.04% | 0.04% | 0.04% | 0.03% | 0.02% |
| SaCas9 nuclease D10A-UGI | 0.02% | 0.04% | 0.01% | 0.01% | 0.02% | 0.01% |
| SaCas9 nuclease | 0.05% | 0.04% | 0.1% | 0.02% | 0.33% | 0.14% |
| BE4-ppAPOBEC1 | 0.57% | 1.52% | 7.06% | 24% | 38.4% | 4.88% |
| BE4-rAPOBEC1 | 0.5% | 7.64% | 21.6% | 13.6% | 43.6% | 1.66% |
| BE4-nls-rAPOBEC1 | 1.13% | 13.7% | 29.2% | 13% | 30.1% | 3.02% |
| no base editor | 0.02% | 0.04% | 0.05% | 0.04% | 0.05% | 0.03% |

FIG. 5C

| | | | | | | | | | | | | | | | | | |
|---|---|---|---|---|---|---|---|---|---|---|---|---|---|---|---|---|---|
| **20. BGX21_rAPOBEC-4 translation** | | | | | | | | | | | | | | | | | |
| **21. BGX22_mfAPOBEC-4 translation** | | | | | | | | | | | | | | | | | |
| 22. BGX23_hAID translation | S | L | R | I | F | T | A | R | L | Y | F | C | E | D | R | K | A |
| 23. BGX24_clAID translation | S | L | R | I | F | A | A | R | L | Y | F | C | E | D | R | K | A |
| 24. BGX25_btAID translation | S | L | R | I | F | T | A | R | L | Y | F | C | D | K | E | R | K |
| 25. BGX26_mAID translation | S | L | R | I | F | T | A | R | L | Y | F | C | E | K | R | K | A |
| 26. BGX27_pmCDA-1 translation | T | L | T | M | H | F | S | R | I | Y | D | R | D | R | E | G | - |
| **27. BGX28_pmCDA-2 translation** | | | | | | | | | | | | | | | | | |
| **28. BGX29_pmCDA-5 translation** | | | | | | | | | | | | | | | | | |
| **29. BGX30_yCD translation** | | | | | | | | | | | | | | | | | |
| 30. BGX31_rAPOBEC-1-delta 177-186 translation | T | L | F | I | Y | I | A | R | L | Y | H | H | A | D | P | R | - |
| 31. BGX32_rAPOBEC-1-delta 202-213 translation | T | L | F | I | Y | I | A | R | L | Y | H | H | A | D | P | R | - |
| 32. BGX33_rAPOBEC-1-YE translation | T | L | F | I | Y | I | A | R | L | Y | H | H | A | D | P | E | - |
| 33. BGX34_rAPOBEC-1-YEE translation | T | L | F | I | Y | I | A | E | L | Y | H | H | A | D | P | E | - |
| 34. BGX35_UGI-UGI-NLS-rAPOBEC1-YEE translation | T | L | F | I | Y | I | A | R | L | Y | H | H | A | D | P | R | - |
| 35. BGX36_UGI-UGI-hAID translation | S | L | R | I | F | T | A | R | L | Y | F | C | E | D | R | K | A |
| 36. BGX37_TadA6.3 translation | | | | | | | | | | | | | | | | | |
| 37. BGX38_TadA7.8 translation | | | | | | | | | | | | | | | | | |
| 38. BGX39_TadA7.9 translation | | | | | | | | | | | | | | | | | |
| 39. BGX1_rAPOBEC-1 translation | T | L | F | I | Y | I | A | R | L | Y | H | H | A | D | P | R | - |

FIG. 7B CONTINUED

| | TC$_{8}$T | AC$_{11}$T |
|---|---|---|
| NoBE | 0.03 | 0.03 |
| SpCas9 D10A-UGI | 0.06 | 0.01 |
| rAPOBEC1 (no Cas9) | 0.02 | 0.01 |
| BE4-rAPOBEC1 | 46.39 | 10.65 |
| BE4-ppAPOBEC1 | 37.92 | 12.27 |
| hAPOBEC3A Y130A | 13.42 | 4.75 |
| rAPOBEC1 K34A H122A | 35.80 | 0.13 |
| rAPOBEC1 K34A R33A | 16.65 | 0.02 |
| ppAPOBEC1 H122A | 30.36 | 0.07 |
| ppAPOBEC1 K34A | 30.17 | 1.50 |
| ppAPOBEC1 R33A | 42.02 | 0.49 |
| ppAPOBEC1 R33A K34A | 39.97 | 0.24 |

Scale: 40, 30, 20, 10

| | TC$_{8}$T | AC$_{11}$T | AC$_{17}$T |
|---|---|---|---|
| NoBE | 0.06 | 0.01 | 0.02 |
| SpCas9 D10A-UGI | 0.03 | 0.02 | 0.02 |
| rAPOBEC1 (no Cas9) | 28.50 | 2.73 | 0.98 |
| BE4-rAPOBEC1 | 23.80 | 1.01 | 0.76 |
| BE4-ppAPOBEC1 | 2.07 | 0.26 | 0.25 |
| hAPOBEC3A Y130A | 0.23 | 0.14 | 0.06 |
| rAPOBEC1 K34A H122A | 0.55 | 0.02 | 0.02 |
| rAPOBEC1 K34A R33A | 0.17 | 0.03 | 0.04 |
| ppAPOBEC1 H122A | 0.29 | 0.05 | 0.05 |
| ppAPOBEC1 K34A | 0.62 | 0.08 | 0.07 |
| ppAPOBEC1 R33A | 0.82 | 0.09 | 0.06 |
| ppAPOBEC1 R33A K34A | 0.11 | 0.03 | 0.01 |

Scale: 20, 10

| | TC$_{6}$C | CC$_{7}$A | AC$_{9}$T | TC$_{11}$C | CC$_{12}$G | GC$_{15}$C | CC$_{16}$T |
|---|---|---|---|---|---|---|---|
| NoBE | 0.01 | 0.02 | 0.02 | 0.01 | 0.04 | 0.02 | 0.01 |
| SpCas9 D10A-UGI | 0.05 | 0.03 | 0.01 | 0.03 | 0.02 | 0.03 | 0.01 |
| rAPOBEC1 (no Cas9) | 0.05 | 0.03 | 0.01 | 0.03 | 0.02 | 0.03 | 0.01 |
| BE4-rAPOBEC1 | 66.47 | 62.99 | 28.28 | 38.75 | 12.08 | 5.56 | 1.01 |
| BE4-ppAPOBEC1 | 60.76 | 57.77 | 44.22 | 25.87 | 6.99 | 7.45 | 0.54 |
| hAPOBEC3A Y130A | 19.72 | 30.40 | 10.20 | 1.36 | 2.98 | 1.93 | 0.15 |
| rAPOBEC1 K34A H122A | 46.38 | 45.02 | 1.37 | 2.85 | 1.75 | 0.29 | 0.08 |
| rAPOBEC1 K34A R33A | 37.90 | 11.20 | 0.24 | 3.64 | 0.23 | 0.24 | 0.01 |
| ppAPOBEC1 H122A | 60.44 | 43.69 | 14.56 | 3.78 | 2.32 | 0.75 | 0.04 |
| ppAPOBEC1 K34A | 59.27 | 51.92 | 7.50 | 5.77 | 0.82 | 0.66 | 0.08 |
| ppAPOBEC1 R33A | 58.73 | 54.64 | 13.81 | 11.14 | 2.60 | 0.80 | 0.04 |
| ppAPOBEC1 R33A K34A | 60.55 | 34.26 | 2.15 | 3.01 | 0.40 | 0.19 | 0.03 |

Scale: 60, 40, 20

| | TC$_{6}$C | CC$_{7}$A | AC$_{9}$T | TC$_{11}$C | CC$_{12}$G | GC$_{15}$C | CC$_{16}$T |
|---|---|---|---|---|---|---|---|
| NoBE | 0.08 | 0.04 | 0.02 | 0.09 | 0.15 | 0.14 | 0.36 |
| SpCas9 D10A-UGI | 0.22 | 0.11 | 0.01 | 0.03 | 0.05 | 0.16 | 0.50 |
| rAPOBEC1 (no Cas9) | 26.83 | 24.89 | 14.40 | 29.14 | 23.79 | 22.96 | 7.16 |
| BE4-rAPOBEC1 | 22.73 | 18.56 | 12.76 | 31.63 | 23.04 | 17.69 | 2.62 |
| BE4-ppAPOBEC1 | 6.36 | 0.64 | 1.16 | 3.09 | 0.84 | 1.96 | 0.80 |
| hAPOBEC3A Y130A | 0.63 | 0.50 | 0.70 | 1.87 | 9.29 | 0.25 | 0.46 |
| rAPOBEC1 K34A H122A | 0.58 | 4.90 | 0.20 | 1.12 | 0.66 | 0.30 | 0.52 |
| rAPOBEC1 K34A R33A | 0.24 | 0.05 | 0.06 | 0.47 | 0.26 | 0.22 | 0.60 |
| ppAPOBEC1 H122A | 0.89 | 0.59 | 0.48 | 0.70 | 0.43 | 0.48 | 0.81 |
| ppAPOBEC1 K34A | 2.91 | 0.19 | 0.36 | 2.46 | 0.26 | 1.85 | 0.52 |
| ppAPOBEC1 R33A | 3.53 | 0.23 | 0.53 | 4.09 | 0.45 | 2.31 | 0.77 |
| ppAPOBEC1 R33A K34A | 0.36 | 0.10 | 0.05 | 0.30 | 0.14 | 0.35 | 0.77 |

Scale: 30, 20, 10

| | GC$_{2}$A | AC$_{4}$C | CC$_{5}$C | CC$_{6}$A | TC$_{14}$T | GC$_{17}$A |
|---|---|---|---|---|---|---|
| NoBE | 0.02 | 0.03 | 0.03 | 0.02 | 0.02 | 0.02 |
| SpCas9 D10A-UGI | 0.01 | 0.02 | 0.01 | 0.03 | 0.03 | 0.03 |
| rAPOBEC1 (no Cas9) | 0.01 | 0.02 | 0.01 | 0.02 | 0.01 | 0.02 |
| BE4-rAPOBEC1 | 0.29 | 8.76 | 10.34 | 17.41 | 23.09 | 0.05 |
| BE4-ppAPOBEC1 | 0.33 | 5.21 | 4.85 | 7.09 | 17.80 | 0.08 |
| hAPOBEC3A Y130A | 0.18 | 1.09 | 0.73 | 6.91 | 0.44 | 0.19 |
| rAPOBEC1 K34A H122A | 0.17 | 0.30 | 9.59 | 18.87 | 0.80 | 0.13 |
| rAPOBEC1 K34A R33A | 0.01 | 0.03 | 0.05 | 0.16 | 0.37 | 0.03 |
| ppAPOBEC1 H122A | 4.00 | 1.23 | 4.29 | 14.10 | 1.76 | 0.74 |
| ppAPOBEC1 K34A | 0.05 | 0.93 | 0.96 | 1.80 | 3.78 | 0.02 |
| ppAPOBEC1 R33A | 0.11 | 1.68 | 1.55 | 3.39 | 5.84 | 0.03 |
| ppAPOBEC1 R33A K34A | 0.02 | 0.14 | 0.18 | 0.39 | 0.46 | 0.02 |

Scale: 20, 15, 10, 5

| | CC$_{6}$A | TC$_{14}$T | GC$_{17}$A |
|---|---|---|---|
| NoBE | 0.01 | 0.09 | 0.04 |
| SpCas9 D10A-UGI | 0.02 | 0.02 | 0.08 |
| rAPOBEC1 (no Cas9) | 1.04 | 20.36 | 0.11 |
| BE4-rAPOBEC1 | 0.29 | 23.44 | 0.10 |
| BE4-ppAPOBEC1 | 0.19 | 19.82 | 0.08 |
| hAPOBEC3A Y130A | 0.19 | 0.48 | 0.09 |
| rAPOBEC1 K34A H122A | 0.09 | 0.45 | 0.07 |
| rAPOBEC1 K34A R33A | 0.02 | 0.12 | 0.07 |
| ppAPOBEC1 H122A | 0.06 | 0.30 | 0.54 |
| ppAPOBEC1 K34A | 0.02 | 1.01 | 0.05 |
| ppAPOBEC1 R33A | 0.02 | 1.87 | 0.04 |
| ppAPOBEC1 R33A K34A | 0.02 | 0.11 | 0.08 |

Scale: 20, 15, 10, 5

FIG. 15A pYY-TSP-A13

| | gC2a | tC6c | cC7a | aC9t | tC11c | cC12g | tC15c | cC16g | gC18c | cC19t | tC21c | cC22g |
|---|---|---|---|---|---|---|---|---|---|---|---|---|
| ppAPOBEC1 R33A K34A | 0.01% | 60% | 35.6% | 1.51% | 2.91% | 0.22% | 0.3% | 0.01% | 0% | 0.02% | 0.08% | 0.02% |
| ppAPOBEC1 R33A | 0.01% | 56.5% | 51.4% | 11.4% | 10.9% | 2.78% | 0.67% | 0.07% | 0% | 0.01% | 0.04% | 0.01% |
| ppAPOBEC1 K34A | 0.02% | 55.8% | 48.1% | 5.76% | 5.15% | 0.87% | 0.76% | 0.02% | 0.02% | 0.01% | 0% | 0.02% |
| ppAPOBEC1 H122A | 3.68% | 52.2% | 39.3% | 11.2% | 3.36% | 1.94% | 0.72% | 0.04% | 0.67% | 0.04% | 0% | 0.03% |
| rAPOBEC1 K34A R33A | 0.01% | 37.7% | 10.2% | 0.22% | 3.29% | 0.11% | 0.2% | 0.01% | 0% | 0.01% | 0.04% | 0.05% |
| rAPOBEC1 (no Cas9) | 0% | 0.07% | 0.04% | 0% | 0.03% | 0.02% | 0.05% | 0.02% | 0.02% | 0% | 0% | 0.04% |
| SaCas9 nuclease D10A-UGI | 0.01% | 0.03% | 0.01% | 0.01% | 0% | 0.05% | 0.03% | 0.06% | 0% | 0.01% | 0.01% | 0.04% |
| SpCas9 nuclease | 0% | 0.06% | 0.31% | 0.05% | 0.06% | 0.1% | 0.11% | 0.11% | 0.08% | 0.76% | 0.15% | 0.01% |
| BE4-ppAPOBEC1 | 0.05% | 60.6% | 56% | 40.2% | 26.7% | 7.55% | 8.42% | 0.44% | 0% | 0.01% | 0% | 0.03% |
| BE4-rAPOBEC1 | 0.11% | 62.2% | 57% | 23.7% | 36.3% | 10.9% | 5.04% | 0.82% | 0.01% | 0% | 0.28% | 0.02% |
| BE4-nls-rAPOBEC1 | 0.19% | 65.1% | 60.8% | 25.5% | 24.1% | 7.97% | 16.8% | 4.14% | 0.02% | 0.02% | 0.51% | 0.03% |
| no base editor | 0.02% | 0.01% | 0.02% | 0.01% | 0% | 0.02% | 0.02% | 0.01% | 0.04% | 0.03% | 0.03% | 0.03% |

FIG. 15B CONT.

pYY-TSP-A14

| | aC9t | gC2c | cC3a | aC5a | tC14c | cC15a | gC21a |
|---|---|---|---|---|---|---|---|
| ppAPOBEC1 R33A K34A | 0.04% | 0.02% | 0.04% | 0.6% | 0.06% | 0.01% | 0.03% |
| ppAPOBEC1 R33A | 0.77% | 0.02% | 0.41% | 4.71% | 0.55% | 0.05% | 0.02% |
| ppAPOBEC1 K34A | 0.28% | 0.02% | 0.13% | 3.43% | 0.24% | 0.02% | 0.03% |
| ppAPOBEC1 H122A | 0.43% | 0.4% | 0.61% | 3.18% | 0.27% | 0.03% | 0.02% |
| hAPOBEC3A Y130A | 2.09% | 0.24% | 0.55% | 10.4% | 0.24% | 0.78% | 0.05% |
| rAPOBEC1 K34A R33A | 0.01% | 0.02% | 0.02% | 0.09% | 0.03% | 0.01% | 0.03% |
| rAPOBEC1 K34A 122A | 0.07% | 0.11% | 0.49% | 0.76% | 0.1% | 0.01% | 0.01% |
| rAPOBEC1 (no Cas9) | 0% | 0.01% | 0.02% | 0.02% | 0.02% | 0.01% | 0.02% |
| SaCas9 nuclease D10A-UGI | 0.01% | 0.02% | 0.01% | 0.01% | 0% | 0% | 0.03% |
| SpCas9 nuclease | 0.05% | 0.04% | 0.06% | 0.02% | 0.05% | 0.07% | 0.02% |
| BE4-ppAPOBEC1 | 8.01% | 0.17% | 1.09% | 18.9% | 7.8% | 1.07% | 0.01% |
| BE4-rAPOBEC1 | 10.2% | 0.1% | 2.89% | 17.2% | 7.31% | 1.39% | 0.02% |
| BE4-nls-rAPOBEC1 | 10.1% | 0.43% | 5.31% | 23.7% | 14% | 3.95% | 0.03% |
| no base editor | 0.02% | 0.02% | 0.01% | 0% | 0.02% | 0.03% | 0.06% |

FIG. 15B CONT.

| | pYY-TSP-A15 | | | |
|---|---|---|---|---|
| | gC2c | cC3a | aC5a | aC18a |
| ppAPOBEC1 R33A K34A | 0.04% | 0.06% | 3.17% | 0.03% |
| ppAPOBEC1 R33A | 0.08% | 0.43% | 15.1% | 0.03% |
| ppAPOBEC1 K34A | 0.06% | 0.14% | 21.3% | 0.02% |
| ppAPOBEC1 H122A | 1.28% | 1.27% | 11.3% | 0.02% |
| hAPOBEC3A Y130A | 0.09% | 0.34% | 10% | 0.04% |
| rAPOBEC1 K34A R33A | 0.05% | 0.02% | 0.73% | 0.01% |
| rAPOBEC1 K34A H122A | 0.13% | 0.76% | 8.25% | 0.02% |
| rAPOBEC1 (no Cas9) | 0.03% | 0.02% | 0.03% | 0.01% |
| SaCas9 nuclease D10A-UGI | 0.03% | 0.01% | 0.02% | 0.01% |
| SpCas9 nuclease | 0.02% | 0.01% | 0.05% | 0.15% |
| BE4-ppAPOBEC1 | 0.14% | 0.37% | 37.9% | 0.09% |
| BE4-rAPOBEC1 | 0.16% | 1.86% | 44.8% | 0.07% |
| BE4-nls-rAPOBEC1 | 0.18% | 1.79% | 45.8% | 0.38% |
| no base editor | 0.03% | 0.03% | 0.02% | 0.02% |

FIG. 15B CONT.

pYY-TSP-A16

| | gC2c | cC3c | cC4a | gC7a | tC12a | aC14t |
|---|---|---|---|---|---|---|
| ppAPOBEC1 R33A K34A | 0.02% | 0.15% | 0.31% | 1.3% | 1.28% | 0.07% |
| ppAPOBEC1 R33A | 0.26% | 0.99% | 1.81% | 10.1% | 17.4% | 0.51% |
| ppAPOBEC1 K34A | 0.1% | 0.36% | 0.79% | 2.91% | 5.69% | 0.26% |
| ppAPOBEC1 H122A | 2.18% | 1.51% | 9.92% | 39.7% | 1.49% | 0.16% |
| hAPOBEC3A Y130A | 0.2% | 0.67% | 10.9% | 23.9% | 0.6% | 7.17% |
| rAPOBEC1 K34A R33A | 0.03% | 0.12% | 0.17% | 0.08% | 0.59% | 0.03% |
| rAPOBEC1 K34A H122A | 0.35% | 5.97% | 15.8% | 13.7% | 0.8% | 0.03% |
| rAPOBEC1 (no Cas9) | 0.03% | 0.04% | 0.04% | 0.04% | 0.03% | 0.02% |
| SaCas9 nuclease D10A-UGI | 0.02% | 0.04% | 0.01% | 0.01% | 0.02% | 0.01% |
| SpCas9 nuclease | 0.05% | 0.04% | 0.1% | 0.02% | 0.33% | 0.14% |
| BE4-ppAPOBEC1 | 0.57% | 1.52% | 7.06% | 24% | 38.4% | 4.88% |
| BE4-rAPOBEC1 | 0.5% | 7.64% | 21.6% | 13.6% | 43.6% | 1.66% |
| BE4-nls-rAPOBEC1 | 1.13% | 13.7% | 29.2% | 13% | 30.1% | 3.02% |
| no base editor | 0.02% | 0.04% | 0.05% | 0.04% | 0.05% | 0.03% |

FIG. 15C pYY-TSP-A17

| | gC2c | cC3c | cC4a | gC7t | tC9c | cC10a | gC13c | cC14t | tC16t |
|---|---|---|---|---|---|---|---|---|---|
| ppAPOBEC1 R33A K34A | 0.13% | 0.76% | 0.79% | 6.66% | 27.8% | 1% | 0.01% | 0.03% | 0.09% |
| ppAPOBEC1 R33A | 0.51% | 3.53% | 5.97% | 28.5% | 47% | 23.9% | 0.05% | 0.05% | 0.98% |
| ppAPOBEC1 K34A | 0.2% | 1.18% | 2.41% | 13.4% | 42.8% | 10.3% | 0.03% | 0.07% | 0.6% |
| ppAPOBEC1 H122A | 9.49% | 7.92% | 23.6% | 46.8% | 35.2% | 12.3% | 2.6% | 0.14% | 0.28% |
| hAPOBEC3A Y130A | 0.57% | 1.11% | 17.8% | 12.2% | 11.7% | 10.4% | 0.44% | 0.29% | 0.21% |
| rAPOBEC1 K34A R33A | 0.06% | 0.18% | 0.36% | 0.37% | 9.54% | 0.3% | 0.01% | 0.01% | 0.05% |
| rAPOBEC1 K34A H122A | 0.84% | 9.21% | 13.3% | 24.6% | 17.7% | 7.51% | 0.06% | 0.13% | 0.07% |
| rAPOBEC1 (no Cas9) | 0.04% | 0.03% | 0.01% | 0% | 0.02% | 0.03% | 0% | 0.01% | 0% |
| SaCas9 nuclease D10A-UGI | 0.01% | 0.02% | 0.01% | 0.03% | 0.03% | 0.02% | 0.01% | 0% | 0.01% |
| SpCas9 nuclease | 0.05% | 0.03% | 0.01% | 0.02% | 0.08% | 0.09% | 0.11% | 0.1% | 0.04% |
| BE4-ppAPOBEC1 | 1.23% | 3.96% | 9.8% | 37.1% | 39.4% | 38.6% | 0.19% | 0.12% | 7.26% |
| BE4-rAPOBEC1 | 0.85% | 13.2% | 23% | 23.3% | 46% | 44.3% | 0.11% | 0.27% | 6.24% |
| BE4-nls-rAPOBEC1 | 1.95% | 23.3% | 32.2% | 29.6% | 46.9% | 43.5% | 0.15% | 0.87% | 13.4% |
| no base editor | 0.01% | 0.03% | 0.02% | 0.02% | 0.02% | 0.06% | 0.01% | 0.02% | 0.03% |

FIG. 15C CONT.

pYY-TSP-A18

| | gC2c | cC3c | aC14t | cC4t | tC9t | gC12a | aC19a |
|---|---|---|---|---|---|---|---|
| ppAPOBEC1 R33A K34A | 0.03% | 0.16% | 0.03% | 0.68% | 15.4% | 0.07% | 0.02% |
| ppAPOBEC1 R33A | 0.07% | 1.15% | 0.49% | 4.11% | 47.4% | 0.22% | 0.02% |
| ppAPOBEC1 K34A | 0.14% | 0.4% | 0.27% | 1.77% | 34.7% | 0.06% | 0.01% |
| ppAPOBEC1 H122A | 5.44% | 1.99% | 0.48% | 23.7% | 30.3% | 10.4% | 0.01% |
| hAPOBEC3A Y130A | 0.76% | 0.55% | 18.4% | 3.32% | 10.3% | 2.11% | 0.03% |
| rAPOBEC1 K34A R33A | 0.02% | 0.11% | 0.02% | 0.2% | 7.79% | 0.06% | 0.03% |
| rAPOBEC1 K34A H122A | 0.79% | 5.51% | 0.06% | 22.8% | 17.2% | 0.59% | 0.02% |
| rAPOBEC1 (no Cas9) | 0.02% | 0% | 0.01% | 0.04% | 0.05% | 0.01% | 0.03% |
| SaCas9 nuclease D10A-UGI | 0.01% | 0.01% | 0.01% | 0.05% | 0.03% | 0.01% | 0.01% |
| SpCas9 nuclease | 0.01% | 0.04% | 0.05% | 0.09% | 0.11% | 0% | 0.12% |
| BE4-ppAPOBEC1 | 0.46% | 1.78% | 8.82% | 14.1% | 40.9% | 0.61% | 0.03% |
| BE4-rAPOBEC1 | 0.32% | 5.54% | 1.91% | 22.6% | 45.1% | 0.26% | 0.06% |
| BE4-nls-rAPOBEC1 | 1.05% | 11% | 8.09% | 32.6% | 51.9% | 0.55% | 0.12% |
| no base editor | 0% | 0% | 0% | 0.05% | 0.05% | 0.01% | 0% |

FIG. 15C CONT.

TS_pYY-TSA-A12

| | gC2a | aC4c | cC5c | cC6a | tC14t | gC17a | gC22a |
|---|---|---|---|---|---|---|---|
| ppAPOBEC1 R33A K34A | 0.01% | 0.03% | 0.03% | 0.02% | 0.06% | 0.06% | 0.02% |
| ppAPOBEC1 R33A | 0.01% | 0.03% | 0.03% | 0.02% | 1.69% | 0.04% | 0% |
| ppAPOBEC1 K34A | 0.01% | 0.02% | 0% | 0.03% | 1.04% | 0.03% | 0.02% |
| ppAPOBEC1 H122A | 0.03% | 0.02% | 0.02% | 0.05% | 0.13% | 0.35% | 0.01% |
| hAPOBEC3A Y130A | 0.03% | 0.05% | 0.05% | 0.15% | 0.28% | 0.13% | 0.02% |
| rAPOBEC1 K34A R33A | 0.01% | 0.01% | 0.01% | 0.03% | 0.11% | 0.04% | 0.04% |
| rAPOBEC1 (no Cas9) | 0.08% | 0.21% | 0.21% | 0.84% | 17% | 0.11% | 0.02% |
| SaCas9 nuclease D10A-UGI | 0.02% | 0.01% | 0% | 0.02% | 0.05% | 0.05% | 0.01% |
| SpCas9 nuclease | 0.01% | 0% | 0% | 0.02% | 0.05% | 0.03% | 0.01% |
| BE4-ppAPOBEC1 | 0.01% | 0.03% | 0.02% | 0.03% | 1.53% | 0.06% | 0.02% |
| BE4-rAPOBEC1 | 0.02% | 0.05% | 0.03% | 0.12% | 15.4% | 0.04% | 0.01% |
| BE4-nls-rAPOBEC1 | 0.02% | 0.06% | 0.07% | 0.11% | 16.9% | 0.12% | 0.01% |

FIG. 15D CONT.

TS_pYY-TSA-A13

| | gC2a | aC6c | aC7a | aC9t | tC11c | cC12g | tC15c | cC16g | gC18c | cC19t | tC21c | cC22g |
|---|---|---|---|---|---|---|---|---|---|---|---|---|
| ppAPOBEC1 R33A K34A | 0% | 0.38% | 0.12% | 0.08% | 0.41% | 0.11% | 0.37% | 0.66% | 0% | 0.01% | 0.02% | 0.07% |
| hAPOBEC3A Y130A | 0.04% | 0.28% | 0.41% | 0.43% | 1.56% | 11% | 0.26% | 0.52% | 0.03% | 0.05% | 0.06% | 0.03% |
| rAPOBEC1 (no Cas9) | 0.03% | 27.2% | 24.7% | 13.9% | 30.9% | 25.7% | 26% | 7.78% | 0.05% | 0.07% | 0.26% | 0.05% |
| SaCas9 nuclease D10A-UGI | 0.05% | 0.08% | 0.01% | 0.02% | 0.12% | 0.13% | 0.19% | 0.56% | 0% | 0.02% | 0% | 0.02% |
| BE4-rAPOBEC1 | 0.02% | 21.5% | 17.2% | 11.4% | 30.3% | 22.2% | 17.9% | 2.61% | 0.01% | 0.02% | 0.08% | 0.08% |
| BE4-nls-rAPOBEC1 | 0.01% | 21.5% | 16.8% | 8.86% | 33.7% | 25.6% | 36.3% | 9.56% | 0.02% | 0% | 0.07% | 0.03% |
| no base editor | 0.01% | 0.06% | 0.08% | 0.01% | 0.11% | 0.11% | 0.14% | 0.36% | 0% | 0.04% | 0.02% | 0.04% |

FIG. 15D CONT.

TS_pYY-TSA-A14

| | aC9t | gC2c | cC3a | aC5a | tC14c | cC15a | gC21a |
|---|---|---|---|---|---|---|---|
| ppAPOBEC1 R33A K34A | 0.02% | 0.02% | 0.02% | 0.02% | 0.06% | 0.03% | 0.04% |
| ppAPOBEC1 R33A | 0.03% | 0.01% | 0.01% | 0.02% | 0.59% | 0.04% | 0.03% |
| ppAPOBEC1 K34A | 0.04% | 0.03% | 0.02% | 0.02% | 0.19% | 0.01% | 0.01% |
| ppAPOBEC1 H122A | 0.05% | 0.02% | 0.01% | 0.02% | 0.11% | 0.03% | 0.02% |
| hAPOBEC3A Y130A | 0.09% | 0.01% | 0.01% | 3.87% | 0.19% | 0.11% | 0.02% |
| rAPOBEC1 K34A R33A | 0.03% | 0.02% | 0.02% | 0.04% | 0.06% | 0.05% | 0.04% |
| rAPOBEC1 K34A H122A | 0.01% | 0.02% | 0.01% | 0.03% | 0.2% | 0.01% | 0.05% |
| rAPOBEC1 (no Cas9) | 8.19% | 0.02% | 0.08% | 0.45% | 22.1% | 9.81% | 0.03% |
| SaCas9 nuclease D10A-UGI | 0.02% | 0.04% | 0.01% | 0.02% | 0.02% | 0.02% | 0.01% |
| SpCas9 nuclease | 0% | 0.01% | 0.03% | 0.03% | 0.06% | 0.01% | 0.03% |
| BE4-ppAPOBEC1 | 0.2% | 0% | 0% | 0.03% | 0.48% | 0.04% | 0.04% |
| BE4-rAPOBEC1 | 2.5% | 0.01% | 0.01% | 0.09% | 15.4% | 1.77% | 0.04% |
| BE4-nls-rAPOBEC1 | 2.54% | 0.01% | 0.04% | 0.06% | 22.6% | 4.25% | 0.04% |
| no base editor | 0.03% | 0.02% | 0.01% | 0.02% | 0.02% | 0.02% | 0.04% |

FIG. 15D CONT.

TS_pYY-TSA-A15

| | gC2c | cC3a | aC5a | aC18a |
|---|---|---|---|---|
| ppAPOBEC1 R33A K34A | 0.02% | 0.01% | 0.05% | 0.03% |
| ppAPOBEC1 R33A | 0.04% | 0.02% | 0.02% | 0.02% |
| ppAPOBEC1 K34A | 0.02% | 0.01% | 0.02% | 0.03% |
| ppAPOBEC1 H122A | 0.04% | 0.04% | 0.02% | 0.02% |
| hAPOBEC3A Y130A | 0.05% | 0.03% | 0.17% | 0.02% |
| rAPOBEC1 K34A R33A | 0.02% | 0.02% | 0.01% | 0.01% |
| rAPOBEC1 K34A H122A | 0.01% | 0.01% | 0.03% | 0.01% |
| rAPOBEC1 (no Cas9) | 0.02% | 0.01% | 0.13% | 0.09% |
| SaCas9 nuclease D10A-UGI | 0.03% | 0% | 0.02% | 0.02% |
| SpCas9 nuclease | 0.02% | 0.01% | 0.06% | 0.01% |
| BE4-ppAPOBEC1 | 0.03% | 0.04% | 0.01% | 0.02% |
| BE4-rAPOBEC1 | 0.02% | 0.03% | 0.04% | 0.04% |
| BE4-nls-rAPOBEC1 | 0.03% | 0.04% | 0.02% | 0.04% |
| no base editor | 0.03% | 0% | 0.01% | 0.03% |

FIG. 15E

TS_pYY-TSA-A16

| | gC2c | cC3c | cC4a | gC7a | tC12a | aC14t |
|---|---|---|---|---|---|---|
| ppAPOBEC1 R33A K34A | 0.01% | 0.02% | 0.02% | 0.01% | 0.07% | 0.01% |
| ppAPOBEC1 R33A | 0.03% | 0.01% | 0.03% | 0.02% | 0.46% | 0.03% |
| ppAPOBEC1 K34A | 0.03% | 0.02% | 0.02% | 0.03% | 0.26% | 0.04% |
| ppAPOBEC1 H122A | 0.02% | 0.02% | 0.03% | 0.05% | 0.13% | 0.01% |
| hAPOBEC3A Y130A | 0.02% | 0.03% | 0.02% | 0.04% | 1.1% | 0.1% |
| rAPOBEC1 K34A R33A | 0.03% | 0.02% | 0.02% | 0.01% | 0.09% | 0.01% |
| rAPOBEC1 K34A H122A | 0.03% | 0.03% | 0.03% | 0.01% | 0.12% | 0.03% |
| rAPOBEC1 (no Cas9) | 0.02% | 0.01% | 0.03% | 0.03% | 8.55% | 0.69% |
| SaCas9 nuclease D10A-UGI | 0.03% | 0.02% | 0.04% | 0.01% | 0.01% | 0.02% |
| SpCas9 nuclease | 0.03% | 0.02% | 0.03% | 0.01% | 0.05% | 0.03% |
| BE4-ppAPOBEC1 | 0.01% | 0.03% | 0.02% | 0.03% | 0.72% | 0.04% |
| BE4-rAPOBEC1 | 0.02% | 0.03% | 0.03% | 0.01% | 6.06% | 0.22% |
| BE4-nls-rAPOBEC1 | 0.02% | 0.03% | 0.01% | 0.01% | 11% | 0.46% |
| no base editor | 0.02% | 0.02% | 0.02% | 0.02% | 0.01% | 0.03% |

FIG. 15E CONT.

TS_pYY-TSA-A17

| | gC2c | cC3c | cC4a | gC7t | tC9c | cC10a | gC13c | cC14t | tC16t |
|---|---|---|---|---|---|---|---|---|---|
| ppAPOBEC1 R33A K34A | 0% | 0.03% | 0.01% | 0.02% | 0.14% | 0.02% | 0.01% | 0.01% | 0.06% |
| ppAPOBEC1 R33A | 0.03% | 0% | 0.03% | 0.02% | 1.63% | 0.08% | 0% | 0.02% | 1.7% |
| ppAPOBEC1 K34A | 0.03% | 0.02% | 0.02% | 0.01% | 0.98% | 0.01% | 0.02% | 0.01% | 0.45% |
| ppAPOBEC1 H122A | 0.03% | 0.02% | 0.03% | 0.07% | 0.16% | 0.05% | 0.22% | 0.02% | 0.09% |
| hAPOBEC3A Y130A | 0.01% | 0.03% | 0.13% | 0.06% | 0.16% | 0.45% | 0.23% | 0.04% | 0.05% |
| rAPOBEC1 K34A R33A | 0.01% | 0.03% | 0.03% | 0.02% | 0.77% | 0.03% | 0.04% | 0.01% | 0.01% |
| rAPOBEC1 K34A H122A | 0.02% | 0.03% | 0.03% | 0.01% | 0.93% | 0.13% | 0.04% | 0.04% | 0.04% |
| rAPOBEC1 (no Cas9) | 0.01% | 0.15% | 0.05% | 0.07% | 21.9% | 14.3% | 0.1% | 0.28% | 9.54% |
| SaCas9 nuclease D10A-UGI | 0.02% | 0.01% | 0.03% | 0.03% | 0.03% | 0.04% | 0.02% | 0.03% | 0.02% |
| SpCas9 nuclease | 0.02% | 0.02% | 0.01% | 0.04% | 0.02% | 0.01% | 0.01% | 0.02% | 0.02% |
| BE4-ppAPOBEC1 | 0.03% | 0.01% | 0.03% | 0.02% | 0.83% | 0.05% | 0.02% | 0% | 0.97% |
| BE4-rAPOBEC1 | 0.02% | 0.02% | 0.01% | 0.02% | 23.9% | 8.7% | 0.04% | 0.05% | 3.35% |
| BE4-nls-rAPOBEC1 | 0.01% | 0.01% | 0.04% | 0.04% | 27.1% | 10.3% | 0.1% | 0.27% | 8.13% |
| no base editor | 0.02% | 0.03% | 0.03% | 0.02% | 0.03% | 0.02% | 0% | 0.02% | 0.01% |

FIG. 15E CONT.

TS_pYY-TSA-A18

| | gC2c | cC3c | aC14t | cC4t | tC9t | gC12a | aC19a |
|---|---|---|---|---|---|---|---|
| ppAPOBEC1 R33A K34A | 0.01% | 0.02% | 0.01% | 0% | 0.04% | 0.03% | 0.02% |
| ppAPOBEC1 R33A | 0.02% | 0.01% | 0.09% | 0.02% | 0.24% | 0.03% | 0.03% |
| ppAPOBEC1 K34A | 0.03% | 0.01% | 0.01% | 0.01% | 0.18% | 0.02% | 0.04% |
| ppAPOBEC1 H122A | 0.07% | 0% | 0.06% | 0.02% | 0.04% | 0.31% | 0.01% |
| hAPOBEC3A Y130A | 0.03% | 0.01% | 0.07% | 0.02% | 0.05% | 0% | 0.01% |
| rAPOBEC1 K34A R33A | 0.01% | 0.01% | 0.03% | 0.02% | 0.03% | 0.01% | 0.02% |
| rAPOBEC1 K34A H122A | 0.01% | 0.04% | 0.02% | 0.03% | 0.02% | 0.01% | 0% |
| rAPOBEC1 (no Cas9) | 0.01% | 0.11% | 2.7% | 0.09% | 10% | 0.34% | 0.03% |
| SaCas9 nuclease D10A-UGI | 0.02% | 0.01% | 0% | 0.01% | 0.02% | 0.04% | 0.01% |
| SpCas9 nuclease | 0.01% | 0.01% | 0.01% | 0% | 0.01% | 0.02% | 0.02% |
| BE4-ppAPOBEC1 | 0% | 0.01% | 0.35% | 0.05% | 0.06% | 0.07% | 0.02% |
| BE4-rAPOBEC1 | 0.02% | 0.01% | 0.51% | 0.06% | 4.46% | 0.06% | 0.03% |
| BE4-nls-rAPOBEC1 | 0.02% | 0.05% | 1.54% | 0.1% | 4.02% | 0.14% | 0.02% |
| no base editor | 0.02% | 0.01% | 0.02% | 0.03% | 0.02% | 0.03% | 0.02% |

FIG. 15E CONT.

```
                  33                  52                 90                 120
BE4-rAPOBEC1   -ELRKETCLLYEINWG...IWRHTSQNTNK...CSITWFLSWSPC...RYPHVTLFIYIARLYHHA-
BE4-mdAPOBEC1  -ELRKETCLLYEIKW-...IWRHSNQNTSQ...CSITWFLSWSPC...HYPNVTLAIFISRLYWHM-
BE4-maAPOBEC1  -ELRKETCLLYEIRW-...IWRHTGQNTSR...CSITWFLSWSPC...GHPNVTLFIYAARLYHHT-
BE4-mAPOBEC1   -ELRKETCLLYEINW-...VWRHTSQNTSN...CSITWFLSWSPC...RHPYVTLFIYIARLYHHT-
BE4-ocAPOBEC1  -ELRKEACLLYEIKW-...TWRSSGKNTTN...CSITWFLSWSPC...QHPGVTLIIFVARLFQHM-
BE4-hAPOBEC1   -ELRKEACLLYEIKW-...IWRSSGKNTTN...CSITWFLSWSPC...RHPGVTLVIYVARLFWHM-
BE4-ppAPOBEC1  -ELRKETCLLYEIKW-...IWRSSGKNTTN...CSITWFLSWSPC...QHPGVTLVIYVARLFWHW-
BE4-mAPOBEC3   -YHRMKPYLCYQLEQ-...---KGCLLSEK...VTITCYLTWSPC...DRPDLILHIYTSRLYFHW-
BE4-hAPOBEC3D  -CGRNESWLCFTMEV-...FRKRGVFRNQV...YEVTWYTSWSPC...RHSNVNLTIFTARLCYFW-
BE4-hAPOBEC3F  -YGRNESWLCFTMEV-...SWKRGVFRNQV...YEVTWYTSWSPC...RHSNVNLTIFTARLYYFW-
BE4-hAPOBEC3C  -NDRNETWLCFTVEG-...SWKTGVFRNQV...YQVTWYTSWSPC...RHSNVNLTIFTARLYYFQ-
BE4-hAPOBEC3G  -RGRHETYLCYEVER-...NQRRGFLCNQA...YRVTCFTSWSPC...KNKHVSLCIFTARIYDD--
BE4-hAPOBEC3A  -IGRHKTYLCYEVER-...DQHRGFLHNQA...YRVTWFTSWSPC...ENTHVRLRIFAARIYDY--
BE4-hAPOBEC3B  -LRRRQTYLCYEVER-...DQHMGFLCNEA...YRVTWFISWSPC...ENTHVRLRIFAARIYDY--
BE4-rAPOBEC4   -TYPQTKHLTFYELR-...GLASNCTGSHT...RHIILYSNNSPC...NYPEVTLSVFFSQLYHTEM
BE4-hAPOBEC4   -TFPQTKHLTFYELK-...GHASSCTGNYI...RHIILYSNNSPC...TYPGITLSIYFSQLYHTEM
BE4-mAPOBEC4   -KGRHETYLCYVVKR-...SLDFGHLRNKS...YRVTWFTSWSPC...WNPNLSLRIFTARLYFCE-
BE4-mfAPOBEC4  -TYPQTKHLTFYELK-...GHASSCTGNYI...RHIILYCNNSPC...TYPGITLSIYFSQLYHTEM
BE4-pmCDA2     -QKPRGTVILFYVEG-...AVNYNKQGTSI...CTLHCYSTYSPC...-STGVRVVIHCCRIYELDV
BE4-pmCDA1     -TERHRTYVIFDVKP-...LW--GYIINNP...YAMTWYMSWSPC...EEQGHTLTMHFSRIYDRDR
BE4-pmCDA5     -TERHRTYVIFDVKP-...LW--GYIINNP...YAMTWYMSWSPC...EEQGHTLMMHFSRLYDRDR
BE4-hAID       -KGRRETYLCYVVKR-...SLDFGYLRNKN...YRVTWFTSWSPC...GNPNLSLRIFTARLYFCE-
BE4-mAID       -KGRRETYLCYVVKR-...SLDFGYLRNKN...YRVTWFTSWSPC...GNPNLSLRIFTARLYFCE-
BE4-btAID      -KGRHETYLCYVVKR-...SLDFGHLRNKA...YRVTWFTSWSPC...GYPNLSLRIFTARLYFCDK
BE4-btAPOBEC2  -SGRNKTFLCYVVEA-...QASRGYLEDEH...YMVTWYVSSSPC...KTKNLRLLILVGRLFMWE-
BE4-mAPOBEC2   -SGRNKTFLCYVVEV-...QATQGYLEDEH...YNVTWYVSSSPC...KTKNLRLLILVSRLFMWE-
BE4-hAPOBEC2   -SGRNKTFLCYVVEA-...QASRGYLEDEH...YNVTWYVSSSPC...KTKNLRLLILVGRLFMWE-
BE4-pgAPOBEC2  -SGRNKTFLCYVVEA-...QASRGYLEDEH...YNVTWYVSSSPC...KTKNLRLLILVGRLFMWE-
BE4-yCD        ------EAALGYKEGG-...NKDGSVLGRGH...KDTTLYTTLSPC...---GIPRCVVGENVNF---
```

FIG. 22B

Target Site: 1

| | tC8t | aC11t | aC17t | tC8t | aC11t | aC17t |
|---|---|---|---|---|---|---|
| BE4-rAPOBEC1 | 40.76% | 9.25% | 0.10% | 22.99% | 1.23% | 0.29% |
| BE4-PrAPOBEC1-H122A | 35.53% | 2.96% | 0.03% | 6.41% | 0.26% | 0.05% |
| BE4-PpAPOBEC1 | 43.62% | 11.28% | 0.21% | 7.00% | 1.35% | 1.16% |
| BE4-PpAPOBEC1-H122A | 28.15% | 1.46% | 0.02% | 0.26% | 0.06% | 0.07% |
| BE4-RrA3F | 53.76% | 4.39% | 0.02% | 3.39% | 0.53% | 0.23% |
| BE4-RrA3F F130L | 42.27% | 7.46% | 0.04% | 1.40% | 0.37% | 0.15% |
| BE4-SsAPOBEC2 | 27.50% | 5.47% | 0.25% | 0.66% | 0.09% | 0.05% |
| BE4-SsAPOBEC2 R54Q | 36.13% | 2.33% | 0.07% | 1.12% | 0.04% | 0.05% |
| BE4-AmAPOBEC1 | 26.75% | 28.55% | 2.50% | 0.13% | 0.65% | 0.38% |

FIG. 25

Target Site: 2

| | gC2a | aC4c | cC5c | cC6a | tC14t | gC17a |
|---|---|---|---|---|---|---|
| BE4-rAPOBEC1 | 0.32% | 8.05% | 10.91% | 18.19% | 22.44% | 0.07% |
| BE4-PrAPOBEC1-H122A | 1.67% | 3.65% | 26.68% | 39.46% | 3.34% | 0.57% |
| BE4-PpAPOBEC1 | 0.45% | 7.30% | 7.41% | 10.31% | 23.07% | 0.08% |
| BE4-PpAPOBEC1-H122A | 3.33% | 0.78% | 3.04% | 10.94% | 1.16% | 0.53% |
| BE4-RrA3F | 3.57% | 1.47% | 6.43% | 8.48% | 13.34% | 5.21% |
| BE4-RrA3F F130L | 9.10% | 4.78% | 17.59% | 22.45% | 6.10% | 4.39% |
| BE4-SsAPOBEC2 | 18.75% | 13.22% | 18.53% | 17.01% | 11.58% | 4.76% |
| BE4-SsAPOBEC2 R54Q | 10.54% | 9.33% | 13.05% | 11.85% | 4.70% | 0.82% |
| BE4-AmAPOBEC1 | 0.53% | 1.00% | 2.53% | 5.38% | 8.88% | 2.03% |

| | gC2a | aC4c | cC5c | cC6a | tC14at | gC17a |
|---|---|---|---|---|---|---|
| BE4-rAPOBEC1 | 0.02% | 0.06% | 0.06% | 0.29% | 19.28% | 0.08% |
| BE4-PrAPOBEC1-H122A | 0.03% | 0.02% | 0.20% | 0.48% | 3.79% | 0.37% |
| BE4-PpAPOBEC1 | 0.02% | 0.05% | 0.03% | 0.06% | 10.89% | 0.15% |
| BE4-PpAPOBEC1-H122A | 0.03% | 0.01% | 0.03% | 0.07% | 0.27% | 0.46% |
| BE4-RrA3F | 0.08% | 0.04% | 0.27% | 0.12% | 7.62% | 1.84% |
| BE4-RrA3F F130L | 0.07% | 0.01% | 0.14% | 0.09% | 3.04% | 0.80% |
| BE4-SsAPOBEC2 | 0.06% | 0.07% | 0.16% | 0.14% | 1.23% | 2.39% |
| BE4-SsAPOBEC2 R54Q | 0.06% | 0.04% | 0.11% | 0.09% | 0.18% | 0.15% |
| BE4-AmAPOBEC1 | 0.03% | 0.03% | 0.02% | 0.08% | 0.46% | 0.19% |

FIG. 25 CONT.

Target Site: 3

| | gC2a | tC6c | cC7a | aC9t | tC11c | cC12g | tC15c | cC16g | gC18c |
|---|---|---|---|---|---|---|---|---|---|
| BE4-rAPOBEC1 | 0.13% | 59.18% | 61.98% | 30.28% | 26.37% | 8.34% | 3.88% | 0.74% | 0.01% |
| BE4-PrAPOBEC1-H122A | 1.13% | 56.93% | 59.81% | 18.40% | 6.88% | 5.17% | 0.87% | 0.40% | 0.07% |
| BE4-PpAPOBEC1 | 0.08% | 55.05% | 58.98% | 44.33% | 13.33% | 3.79% | 2.84% | 0.15% | 0.04% |
| BE4-PpAPOBEC1-H122A | 2.74% | 50.84% | 40.99% | 14.04% | 1.88% | 0.99% | 0.40% | 0.07% | 0.36% |
| BE4-RrA3F | 0.67% | 63.30% | 66.77% | 24.05% | 10.51% | 3.35% | 0.49% | 0.25% | 0.06% |
| BE4-RrA3F F130L | 1.57% | 60.15% | 64.80% | 35.41% | 10.59% | 3.76% | 0.37% | 0.28% | 0.14% |
| BE4-SsAPOBEC2 | 23.00% | 53.35% | 55.63% | 15.28% | 25.13% | 26.36% | 10.53% | 4.85% | 1.72% |
| BE4-SsAPOBEC2 R54Q | 14.58% | 45.37% | 31.87% | 8.68% | 21.18% | 23.29% | 8.77% | 0.39% | 0.56% |
| BE4-AmAPOBEC1 | 0.32% | 52.48% | 52.88% | 37.56% | 11.59% | 13.07% | 1.04% | 0.55% | 0.05% |

FIG. 25 CONT.

Target Site: 3

| | gC2a | tC6c | cC7a | aC9t | tC11c | cC12g | tC15c | cC16g | gC18c |
|---|---|---|---|---|---|---|---|---|---|
| BE4-rAPOBEC1 | 0.03% | 19.12% | 18.67% | 13.95% | 18.93% | 17.33% | 9.56% | 2.43% | 0.03% |
| BE4-PpAPOBEC1-H122A | 0.05% | 3.14% | 19.97% | 5.10% | 3.58% | 5.69% | 1.39% | 1.03% | 0.04% |
| BE4-PpAPOBEC1 | 0.03% | 13.95% | 5.88% | 7.66% | 9.19% | 3.80% | 8.07% | 1.81% | 0.01% |
| BE4-PpAPOBEC1-H122A | 0.06% | 0.72% | 0.50% | 0.40% | 0.20% | 0.32% | 0.23% | 0.63% | 0.16% |
| BE4-RrA3F | 0.04% | 17.69% | 9.48% | 1.03% | 2.96% | 6.14% | 5.14% | 1.54% | 0.08% |
| BE4-RrA3F F130L | 0.03% | 13.68% | 5.75% | 0.41% | 1.27% | 5.73% | 2.42% | 1.07% | 0.05% |
| BE4-SsAPOBEC2 | 0.24% | 8.76% | 2.63% | 0.24% | 0.52% | 2.03% | 1.17% | 2.52% | 0.09% |
| BE4-SsAPOBEC2 R54Q | 0.15% | 2.39% | 1.56% | 0.48% | 0.31% | 0.42% | 1.31% | 1.71% | 0.06% |
| BE4-AmAPOBEC1 | 0.02% | 1.21% | 1.42% | 0.51% | 0.68% | 2.60% | 0.29% | 0.67% | 0.03% |

FIG. 25 CONT.

Target Site: 4

| | gC2c | cC3a | aC5a | aC9t | tC14c | cC15a | gC2c | cC3a | aC5a | cC9t | tC14c | cC15a |
|---|---|---|---|---|---|---|---|---|---|---|---|---|
| BE4-rAPOBEC1 | 0.10% | 1.70% | 9.98% | 6.16% | 4.18% | 0.70% | 0.02% | 0.03% | 0.07% | 3.43% | 16.69% | 2.60% |
| BE4-rAPOBEC1-H122A | 0.36% | 3.06% | 5.71% | 1.72% | 0.51% | 0.16% | 0.02% | 0.03% | 0.03% | 0.46% | 2.51% | 0.44% |
| BE4-PpAPOBEC1 | 0.15% | 0.98% | 14.52% | 7.41% | 5.57% | 0.45% | 0.03% | 0.02% | 0.14% | 1.48% | 4.29% | 0.36% |
| BE4-PpAPOBEC1-H122A | 0.27% | 0.42% | 1.92% | 0.29% | 0.13% | 0.03% | 0.03% | 0.04% | 0.03% | 0.07% | 0.10% | 0.04% |
| BE4-RrA3F | 0.75% | 0.19% | 8.93% | 6.49% | 1.15% | 0.22% | 0.04% | 0.02% | 0.03% | 0.41% | 7.46% | 0.51% |
| BE4-RrA3F F130L | 2.68% | 1.37% | 5.16% | 0.78% | 0.44% | 0.09% | 0.02% | 0.01% | 0.02% | 0.08% | 3.44% | 0.18% |
| BE4-SsAPOBEC2 | 6.82% | 3.38% | 3.19% | 1.16% | 0.84% | 0.28% | 0.03% | 0.05% | 0.04% | 0.03% | 5.10% | 2.11% |
| BE4-SsAPOBEC2 R54Q | 5.38% | 1.92% | 3.18% | 0.46% | 0.16% | 0.08% | 0.02% | 0.02% | 0.03% | 0.04% | 0.33% | 0.14% |
| BE4-AmAPOBEC1 | 0.25% | 0.67% | 3.85% | 1.25% | 6.71% | 3.89% | 0.03% | 0.02% | 0.03% | 0.08% | 1.56% | 0.20% |

FIG. 25 CONT.

Target Site: 5

| | gC2c | cC3a | aC5a | aC18a | gC2c | cC3a | aC5a | aC18a |
|---|---|---|---|---|---|---|---|---|
| BE4-rAPOBEC1 | 0.10% | 0.90% | 24.59% | 0.04% | 0.03% | 0.03% | 0.05% | 0.03% |
| BE4-rAPOBEC1-H122A | 0.54% | 3.82% | 12.51% | 0.03% | 0.04% | 0.02% | 0.02% | 0.03% |
| BE4-PpAPOBEC1 | 0.11% | 0.30% | 22.82% | 0.03% | 0.03% | 0.02% | 0.07% | 0.01% |
| BE4-PpAPOBEC1-H122A | 0.25% | 0.29% | 2.43% | 0.02% | 0.03% | 0.01% | 0.03% | 0.02% |
| BE4-RrA3F | 1.31% | 0.34% | 7.04% | 0.02% | 0.03% | 0.01% | 0.03% | 0.02% |
| BE4-RrA3F F130L | 5.29% | 3.27% | 6.52% | 0.03% | 0.04% | 0.01% | 0.03% | 0.02% |
| BE4-SsAPOBEC2 | 7.91% | 5.02% | 3.97% | 0.02% | 0.03% | 0.02% | 0.04% | 0.01% |
| BE4-SsAPOBEC2 R54Q | 5.41% | 3.41% | 3.01% | 0.01% | 0.04% | 0.03% | 0.02% | 0.02% |
| BE4-AmAPOBEC1 | 0.29% | 0.39% | 2.11% | 0.02% | 0.02% | 0.03% | 0.03% | 0.03% |

FIG. 25 CONT.

Target Site: 6

| | gC2c | cC3c | cC4a | gC7a | tC12a | aC14t | gC2c | cC3c | cC4a | gC7a | tC12a | aC14t |
|---|---|---|---|---|---|---|---|---|---|---|---|---|
| BE4-rAPOBEC1 | 0.41% | 7.44% | 22.23% | 14.79% | 35.98% | 1.38% | 0.02% | 0.02% | 0.02% | 0.04% | 8.22% | 0.41% |
| BE4-rAPOBEC1-H122A | 3.07% | 20.92% | 41.58% | 49.05% | 4.40% | 0.35% | 0.01% | 0.03% | 0.03% | 0.08% | 1.18% | 0.06% |
| BE4-PpAPOBEC1 | 0.39% | 1.27% | 5.25% | 26.30% | 28.97% | 2.82% | 0.03% | 0.02% | 0.03% | 0.03% | 3.32% | 0.37% |
| BE4-PpAPOBEC1-H122A | 2.52% | 1.15% | 9.68% | 42.45% | 1.10% | 0.15% | 0.02% | 0.02% | 0.02% | 0.04% | 0.14% | 0.03% |
| BE4-RrA3F | 0.16% | 0.27% | 11.42% | 56.94% | 10.59% | 0.09% | 0.03% | 0.02% | 0.03% | 0.69% | 4.77% | 0.07% |
| BE4-RrA3F F130L | 0.89% | 3.65% | 39.64% | 50.71% | 8.67% | 0.24% | 0.02% | 0.01% | 0.03% | 0.48% | 2.28% | 0.02% |
| BE4-SsAPOBEC2 | 16.64% | 20.56% | 41.25% | 45.98% | 18.02% | 2.50% | 0.04% | 0.05% | 0.06% | 0.13% | 0.27% | 0.06% |
| BE4-SsAPOBEC2 R54Q | 31.02% | 28.51% | 38.82% | 49.43% | 4.61% | 2.77% | 0.03% | 0.01% | 0.02% | 0.11% | 0.07% | 0.03% |
| BE4-AmAPOBEC1 | 0.60% | 2.22% | 8.37% | 21.39% | 24.69% | 6.76% | 0.01% | 0.15% | 0.23% | 0.12% | 1.00% | 0.04% |

FIG. 25 CONT.

Target Site: 7

| | gC2c | cC3c | cC4a | gC7t | tC9c | cC10a | gC13c | cC14t | tC16t |
|---|---|---|---|---|---|---|---|---|---|
| BE4-rAPOBEC1 | 0.84% | 11.50% | 20.34% | 20.52% | 43.49% | 41.11% | 0.08% | 0.28% | 5.63% |
| BE4-rAPOBEC1-H122A | 6.16% | 29.39% | 39.05% | 47.38% | 40.97% | 28.36% | 0.73% | 1.31% | 0.56% |
| BE4-PpAPOBEC1 | 1.15% | 3.42% | 8.73% | 35.45% | 41.09% | 38.31% | 0.14% | 0.10% | 5.81% |
| BE4-PpAPOBEC1-H122A | 7.35% | 5.56% | 18.61% | 40.80% | 28.41% | 9.29% | 1.86% | 0.09% | 0.23% |
| BE4-RrA3F | 15.41% | 5.30% | 18.08% | 50.53% | 48.48% | 33.97% | 4.22% | 0.16% | 0.21% |
| BE4-RrA3F F130L | 30.94% | 16.65% | 36.21% | 45.47% | 44.35% | 38.21% | 7.87% | 0.08% | 0.18% |
| BE4-SsAPOBEC2 | 36.67% | 31.98% | 35.43% | 35.63% | 34.04% | 33.34% | 10.09% | 1.88% | 1.05% |
| BE4-SsAPOBEC2 R54Q | 39.09% | 29.70% | 29.53% | 39.63% | 24.95% | 13.94% | 13.41% | 6.94% | 0.26% |
| BE4-AmAPOBEC1 | 13.89% | 3.49% | 11.40% | 19.31% | 25.11% | 32.26% | 0.78% | 0.21% | 0.24% |

FIG. 25 CONT.

Target Site: 7

| | gC2c | cC3c | cC4a | gC7t | tC9c | cC10a | gC13c | cC14t | tC16t |
|---|---|---|---|---|---|---|---|---|---|
| BE4-rAPOBEC1 | 0.02% | 0.05% | 0.04% | 0.04% | 25.29% | 9.78% | 0.04% | 0.13% | 4.39% |
| BE4-rAPOBEC1-H122A | 0.04% | 0.09% | 0.04% | 0.20% | 6.72% | 2.41% | 0.31% | 0.26% | 0.27% |
| BE4-PpAPOBEC1 | 0.03% | 0.03% | 0.02% | 0.05% | 6.66% | 0.98% | 0.03% | 0.03% | 9.35% |
| BE4-PpAPOBEC1-H122A | 0.03% | 0.02% | 0.03% | 0.12% | 0.15% | 0.10% | 0.20% | 0.04% | 0.19% |
| BE4-RrA3F | 0.18% | 0.03% | 0.03% | 2.25% | 2.21% | 3.27% | 6.81% | 0.36% | 0.33% |
| BE4-RrA3F F130L | 0.10% | 0.02% | 0.02% | 1.81% | 1.14% | 2.51% | 6.55% | 0.11% | 0.13% |
| BE4-SsAPOBEC2 | 0.54% | 0.08% | 0.28% | 0.73% | 0.17% | 0.46% | 0.52% | 0.03% | 0.15% |
| BE4-SsAPOBEC2 R54Q | 0.18% | 0.09% | 0.12% | 0.48% | 0.11% | 0.10% | 0.22% | 0.03% | 0.06% |
| BE4-AmAPOBEC1 | 0.03% | 0.03% | 0.02% | 0.03% | 0.12% | 1.16% | 0.08% | 0.03% | 0.03% |

FIG. 25 CONT.

Target Site: 8

| | qC2c | cC3c | cC4t | tC9t | qC12a | aC14t |
|---|---|---|---|---|---|---|
| BE4-rAPOBEC1 | 0.34% | 5.35% | 20.66% | 46.61% | 0.32% | 2.24% |
| BE4-rAPOBEC1-H122A | 3.66% | 19.53% | 41.23% | 39.02% | 2.59% | 0.43% |
| BE4-PpAPOBEC1 | 0.41% | 1.47% | 9.72% | 46.12% | 0.60% | 5.95% |
| BE4-PpAPOBEC1-H122A | 4.07% | 2.10% | 17.92% | 25.52% | 8.71% | 0.38% |
| BE4-RrA3F | 13.33% | 3.58% | 12.92% | 49.70% | 11.68% | 0.56% |
| BE4-RrA3F F130L | 25.08% | 12.50% | 34.06% | 45.67% | 12.46% | 0.30% |
| BE4-SsAPOBEC2 | 42.96% | 34.92% | 37.29% | 30.03% | 33.83% | 2.23% |
| BE4-SsAPOBEC2 R54Q | 47.39% | 28.91% | 27.57% | 21.98% | 16.94% | 3.88% |
| BE4-AmAPOBEC1 | 12.35% | 2.95% | 9.30% | 22.00% | 41.95% | 19.82% |

| | qC2c | cC3c | cC4t | tC9t | qC12a | aC14t |
|---|---|---|---|---|---|---|
| BE4-rAPOBEC1 | 0.02% | 0.02% | 0.04% | 5.71% | 0.07% | 0.70% |
| BE4-rAPOBEC1-H122A | 0.03% | 0.07% | 0.04% | 0.43% | 0.28% | 0.07% |
| BE4-PpAPOBEC1 | 0.07% | 0.07% | 0.04% | 2.57% | 0.10% | 1.89% |
| BE4-PpAPOBEC1-H122A | 0.09% | 0.02% | 0.04% | 0.13% | 0.23% | 0.07% |
| BE4-RrA3F | 0.24% | 0.07% | 0.07% | 1.12% | 4.21% | 0.27% |
| BE4-RrA3F F130L | 0.17% | 0.04% | 0.08% | 0.64% | 2.08% | 0.05% |
| BE4-SsAPOBEC2 | 1.02% | 0.10% | 0.21% | 0.17% | 0.98% | 0.07% |
| BE4-SsAPOBEC2 R54Q | 0.35% | 0.03% | 0.11% | 0.08% | 0.30% | 0.07% |
| BE4-AmAPOBEC1 | 0.05% | 0.03% | 0.04% | 0.10% | 0.36% | 0.06% |

FIG. 25 CONT.

Target Site: 9

| | gC2c | cC3t | tC5t | tC10t | gC2c | cC3t | tC5a | tC10t |
|---|---|---|---|---|---|---|---|---|
| BE4-rAPOBEC1 | 0.37% | 2.09% | 8.17% | 7.78% | 0.02% | 0.04% | 0.34% | 0.51% |
| BE4-rAPOBEC1-H122A | 1.71% | 3.30% | 5.36% | 4.40% | 0.02% | 0.03% | 0.03% | 0.06% |
| BE4-PpAPOBEC1 | 0.30% | 0.84% | 7.55% | 6.88% | 0.03% | 0.01% | 0.24% | 0.22% |
| BE4-PpAPOBEC1-H122A | 1.07% | 0.61% | 2.66% | 1.38% | 0.01% | 0.02% | 0.02% | 0.03% |
| BE4-RrA3F | 3.43% | 0.58% | 8.43% | 9.23% | 0.03% | 0.02% | 0.03% | 0.13% |
| BE4-RrA3F F130L | 3.50% | 1.64% | 4.20% | 4.06% | 0.03% | 0.02% | 0.03% | 0.03% |
| BE4-SsAPOBEC2 | 2.79% | 2.23% | 2.66% | 2.08% | 0.49% | 0.15% | 0.25% | 0.06% |
| BE4-SsAPOBEC2 R54Q | 2.47% | 1.57% | 2.37% | 2.05% | 0.14% | 0.07% | 0.09% | 0.03% |
| BE4-AmAPOBEC1 | 3.24% | 0.56% | 3.16% | 6.20% | 0.02% | 0.03% | 0.02% | 0.02% |

FIG. 25 CONT.

Target Site: 10

| | gC2c | cC3t | gC7a | aC17c | cC18a | gC2c | cC3t | gC7a | aC17c | cC18a |
|---|---|---|---|---|---|---|---|---|---|---|
| BE4-rAPOBEC1 | 1.21% | 17.42% | 29.56% | 0.13% | 0.05% | 0.02% | 0.03% | 0.16% | 0.08% | 0.03% |
| BE4-rAPOBEC1-H122A | 8.65% | 35.84% | 47.97% | 0.03% | 0.11% | 0.04% | 0.04% | 0.66% | 0.03% | 0.05% |
| BE4-PpAPOBEC1 | 1.20% | 6.42% | 40.21% | 0.06% | 0.03% | 0.02% | 0.05% | 0.10% | 0.42% | 0.04% |
| BE4-PpAPOBEC1-H122A | 5.32% | 5.39% | 41.15% | 0.03% | 0.02% | 0.03% | 0.03% | 0.43% | 0.04% | 0.03% |
| BE4-RrA3F | 20.07% | 9.40% | 43.52% | 0.05% | 0.04% | 0.03% | 0.03% | 0.83% | 0.04% | 0.04% |
| BE4-RrA3F F130L | 35.34% | 19.31% | 49.60% | 0.06% | 0.05% | 0.03% | 0.02% | 0.62% | 0.03% | 0.04% |
| BE4-SsAPOBEC2 | 42.50% | 37.03% | 38.66% | 0.07% | 0.07% | 0.09% | 0.04% | 0.18% | 0.03% | 0.03% |
| BE4-SsAPOBEC2 R54Q | 31.44% | 27.83% | 44.55% | 0.04% | 0.05% | 0.05% | 0.04% | 0.57% | 0.02% | 0.04% |
| BE4-AmAPOBEC1 | 1.59% | 3.39% | 26.56% | 0.05% | 0.03% | 0.03% | 0.02% | 0.06% | 0.04% | 0.03% |

FIG. 25 CONT.

PpAPOBEC1

RrA3F

AmAPOBEC1

SsAPOBEC2

NUCLEOBASE EDITORS HAVING REDUCED OFF-TARGET DEAMINATION AND METHODS OF USING SAME TO MODIFY A NUCLEOBASE TARGET SEQUENCE

CROSS REFERENCE TO RELATED APPLICATIONS

This application is the U.S. national phase application, pursuant to 35 U.S.C. § 371, of PCT International Application No. PCT/US2020/016288, filed Jan. 31, 2020, which claims the benefit of U.S. Provisional Application Nos. 62/799,702, filed Jan. 31, 2019; 62/835,456, filed Apr. 17, 2019; and 62/941,569, filed Nov. 27, 2019, the contents of each of which are incorporated by reference herein in its entirety.

SEQUENCE LISTING

The instant application contains a Sequence Listing which has been submitted electronically in ASCII format and is hereby incorporated by reference in its entirety. Said ASCII copy, created on Mar. 19, 2020, is named 58790689_1.txt and is 998,803 bytes in size.

BACKGROUND OF THE DISCLOSURE

Targeted editing of nucleic acid sequences, for example, the targeted cleavage or the targeted modification of genomic DNA is a highly promising approach for the study of gene function and also has the potential to provide new therapies for human genetic diseases. Currently available base editors include cytidine base editors (e.g., BE4) that convert target C·G base pairs to T·A and adenine base editors (e.g., ABE7.10) that convert A·T to G·C. There is a need in the art for improved base editors capable of inducing modifications within a target sequence with greater specificity and efficiency.

SUMMARY OF THE DISCLOSURE

As described below, the present invention features nucleobase editors and multi-effector nucleobase editors having an improved editing profile with minimal off-target deamination, compositions comprising such editors, and methods of using the same to generate modifications in target nucleobase sequences.

In one aspect provided herein is a cytidine base editor comprising (i) a polynucleotide programmable DNA binding domain and (ii) a cytidine deaminase, wherein the cytidine base editor has an increased ratio of in cis to in trans activity (in cis:in trans) as compared to a standard cytidine base editor.

In some embodiments, the standard cytidine base editor comprises (i) a polynucleotide programmable DNA binding domain and (ii) an APOBEC cytidine deaminase. In some embodiments, the APOBEC cytidine deaminase of the standard cytidine base editor is a rat APOBEC-1 cytidine deaminase (rAPOBEC-1). In some embodiments, the polynucleotide programmable DNA binding domain of the standard cytidine base editor is a Cas9 nickase. In some embodiments, the standard cytidine base editor comprises a uracil glycosylase inhibitor (UGI) domain. In some embodiments, the standard cytidine base editor is a BE3 or BE4. In some embodiments, the increased ratio of in cis to in trans activity is increased by at least 2, 2.5, 5, 10, 15, 20, 25, 30, 35, 40, 45, 50, 60 fold or more. In some embodiments, the cytidine base editor has at least 50%, 60%, 70%, 80%, 90%, 95%, 100%, 105%, 110%, 115%, 120%, or more in cis activity as compared to the standard cytidine base editor.

In some embodiments, the cytidine base editor has at least 2, 5, 10, 15, 20, 25, 30, 35, 40, 45, 50, 60, or more fold less in trans activity as compared to the standard cytidine base editor.

In some embodiments, the cytidine deaminase is selected from the group consisting of APOBEC1, APOBEC2, APOBEC3A, APOBEC3B, APOBEC3C, APOBEC3D, APOBEC3E, APOBEC3F, APOBEC3G, APOBEC3H, APOBEC4, Activation-induced (cytidine) deaminase (AID), hAPOBEC1, rAPOBEC1, ppAPOBEC1, AmAPOBEC1 (BEM3.31), ocAPOBEC1, SSAPOBEC2 (BEM3.39), hAPOBEC3A, maAPOBEC1, mdAPOBEC1, cytidine deaminase 1 (CDA1), hA3A, RrA3F (BEM3.14), PmCDA1, AID (Activation-induced cytidine deaminase; AICDA), hAID, and FENRY. In some embodiments, the cytidine deaminase is APOBEC1. In some embodiments, the cytidine deaminase is (a) an APOBEC-1 from *Mesocricetus auratus* (MaAPOBEC-1), *Pongo pygmaeus* (PpAPOBEC-1), *Oryctolagus cuniculus* (OcAPOBEC-1), *Monodelphis domestica* (MdAPOBEC-1), or *Alligator mississippiensis* (AmAPOBEC-1), (b) an APOBEC-2 from *Pongo pygmaeus* (PpAPOBEC-2), *Bos taurus* (BtAPOBEC-2), or *Sus scrofa* (SsAPOBEC-2), (c) an APOBEC-4 from *Macaca fascicularis* (MfAPOBEC-4), (d) an AID from *Canis lupus* familaris (ClAID) or *Bos Taurus* (BtAID), (e) a yeast cytosine deaminase (yCD) from *Saccharomyces cerevisiae*, (f) an APOBEC-3F from *Rhinopithecus roxellana* (RrA3F), or (g) a cytidine deaminase having an amino acid sequence that is at least 80%, 85%, 90%, 95%, 96%, 97%, 98%, or 99% identical to any one of (a)-(f).

In some embodiments, the cytidine deaminase is an APOBEC-1 from *Mesocricetus auratus* (MaAPOBEC-1), *Pongo pygmaeus* (PpAPOBEC-1), *Oryctolagus cuniculus* (OcAPOBEC-1), *Monodelphis domestica* (MdAPOBEC-1), or a cytidine deaminase having an amino acid sequence that is at least 80%, 85%, 90%, 95%, 96%, 97%, 98%, or 99% identical thereto. In some embodiments, the cytidine deaminase is rAPOBEC1. In some embodiments, the cytidine deaminase is hAPOBEC3A. In some embodiments, the cytidine deaminase is ppAPOBEC1. In some embodiments, the cytidine deaminase is an APOBEC-2 derived from *Pongo pygmaeus* (PpAPOBEC-2), *Bos taurus* (BtAPOBEC-2), or *Sus scrofa* (SsAPOBEC-2), or a cytidine deaminase having an amino acid sequence that is at least 80%, 85%, 90%, 95%, 96%, 97%, 98%, or 99% identical thereto. In some embodiments, the cytidine deaminase is an APOBEC-4 derived from *Macaca fascicularis* (MfAPOBEC-4), or a cytidine deaminase having an amino acid sequence that is at least 80%, 85%, 90%, 95%, 96%, 97%, 98%, or 99% identical thereto. In some embodiments, the cytidine deaminase is an AID from *Canis lupus* familaris (ClAID), *Bos Taurus* (BtAID), or a cytidine deaminase having an amino acid sequence that is at least 80%, 85%, 90%, 95%, 96%, 97%, 98%, or 99% identical thereto.

In some embodiments, the cytidine deaminase is a yeast cytosine deaminase (yCD) from *Saccharomyces cerevisiae*, or a cytidine deaminase having an amino acid sequence that is at least 80%, 85%, 90%, 95%, 96%, 97%, 98%, or 99% identical thereto. In some embodiments, the cytidine deaminase is an APOBEC-3F from *Rhinopithecus roxellana* (RrA3F), or a cytidine deaminase having an amino acid sequence that is at least 80%, 85%, 90%, 95%, 96%, 97%, 98%, or 99% identical thereto. In some embodiments, the cytidine deaminase is any one of the cytidine deaminases provided in Table 13, or a cytidine deaminase having an amino acid sequence that is at least 80%, 85%, 90%, 95%, 96%, 97%, 98%, or 99% identical thereto. In some embodiments, the cytidine deaminase is APOBEC-3F from *Rhinopithecus roxellana* (RrA3F), APOBEC-1 from *Alligator mississippiensis* (AmAPOBEC-1), APOBEC-2 from *Sus scrofa* (SsAPOBEC-2), APOBEC-1 from *Pongo pygmaeus* (PpAPOBEC-1), or a cytidine deaminase having an amino acid sequence that is at least 80%, 85%, 90%, 95%, 96%, 97%, 98%, or 99% identical thereto.

In some embodiments, the cytidine deaminase comprises one or more alterations at positions R15X, R16X, H21X, R30X, R33X, K34X, R52X, K60X, R118X, H121X, H122X, R126X, R128X, R169X, R198X, T36X, H53X, V62X, L88X, W90X, Y120X or R132X as numbered in SEQ ID NO: 1 or one or more corresponding alterations thereof, wherein X is any amino acid.

In some embodiments, the cytidine deaminase comprises one or more alterations selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E as numbered in SEQ ID NO: 1 or one or more corresponding alterations thereof. In some embodiments, the cytidine deaminase comprises a combination of alterations selected from the group consisting of: K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E as numbered in SEQ ID NO: 1 or corresponding alterations thereof. In some embodiments, the cytidine deaminase comprises an alteration at position Y120F and one or more alterations selected from the group consisting of R33A, W90F, K34A, R52A, H122A, and H121A as numbered in SEQ ID NO: 1, or one or more corresponding alterations thereof. In some embodiments, the cytidine deaminase comprises an alterations at position Y130X or R28X as numbered in SEQ ID NO: 1 or a corresponding alteration thereof, wherein X is any amino acid.

In some embodiments, the cytidine deaminase comprises an alterations at position Y130A or R28A as numbered in SEQ ID NO: 1 or a corresponding alteration thereof. In some embodiments, the cytidine deaminase comprises alterations at positions Y130A and R28A as numbered in SEQ ID NO: 1 or corresponding alterations thereof. In some embodiments, the cytidine deaminase comprises one or more alterations at positions H122X, K34X, R33X, W90X, or R128X as numbered in SEQ ID NO: 1, or one or more corresponding alterations thereof, wherein X is any amino acid. In some embodiments, the cytidine deaminase comprises one or more alterations selected from the group consisting of H122A, K34A, R33A, W90F, W90A, and R128A as numbered in SEQ ID NO: 1, or one or more corresponding alterations thereof. In some embodiments, the cytidine deaminase comprises a combination of alterations selected from the group consisting of: R33A+K34A, W90F+K34A, R33A+K34A+W90F, and R33A+K34A+H122A+W90F as numbered in SEQ ID NO: 1 or corresponding alterations thereof.

In some embodiments, the cytidine deaminase comprises an amino acid sequence that has at least 80% identity to amino acid sequence:

(SEQ ID NO: 154)
MTSEKGPSTGDPTLRRRIESWEFDVFYDPRELRKETCLLYEIKWGMSRK
IWRSSGKNTTNHVEVNFIKKFTSERRFHSSISCSITWFLSWSPCWECSQ
AIREFLSQHPGVTLVIYVARLFWHMDQRNRQGLRDLVNSGVTIQIMRAS
EYYHCWRNFVNYPPGDEAHWPQYPPLWMMLYALELHCIILSLPPCLKIS
RRWQNHLAFFRLHLQNCHYQTIPPHILLATGLIHPSVTWR.

In some embodiments, the cytidine deaminase comprises an amino acid sequence that has at least 80% identity to amino acid sequence:

(SEQ ID NO: 155)
MKPQIRDHRPNPMEAMYPHIFYFHFENLEKAYGRNETWLCFTVEIIKQY
LPVPWKKGVFRNQVDPETHCHAEKCFLSWFCNNTLSPKKNYQVTWYTSW
SPCPECAGEVAEFLAEHSNVKLTIYTARLYYFWDTDYQEGLRSLSEEGA
SVEIMDYEDFQYCWENFVYDDGEPFKRWKGLKYNFQSLTRRLREILQ.

In some embodiments, the cytidine deaminase comprises an amino acid sequence that has at least 80% identity to amino acid sequence:

(SEQ ID NO: 156)
MADSSEKMRGQYISRDTFEKNYKPIDGTKEAHLLCEIKWGKYGKPWLHW
CQNQRMNIHAEDYFMNNIFKAKKHPVHCYVTWYLSWSPCADCASKIVKF
LEERPYLKLTIYVAQLYYHTEEENRKGLRLLRSKKVIIRVMDISDYNYC
WKVFVSNQNGNEDYWPLQFDPWVKENYSRLLDIFWESKCRSPNPW.

In some embodiments, the cytidine deaminase comprises an amino acid sequence that has at least 80% identity to amino acid sequence:

(SEQ ID NO: 157)
MDPQRLRQWPGPGPASRGGYGORPRIRNPEEWFHELSPRTFSFHFRNLR
FASGRNRSYICCQVEGKNCFFQGIFQNQVPPDPPCHAELCFLSWFQSWG
LSPDEHYYVTWFISWSPCCECAAKVAQFLEENRNVSLSLSAARLYYFWK
SESREGLRRLSDLGAQVGIMSFQDFQHCWNNFVHNLGMPFQPWKKLHKN
YQRLVTELKQILREEPATYGSPQAQGKVRIGSTAAGLRHSHSHTRSEAH
LRPNHSSRQHRILNPPREARARTCVLVDASWICYR.

In some embodiments, the cytidine deaminase comprises a H122A alteration. In some embodiments, the cytidine base editor of any one of aspects above, further comprises at least one adenosine deaminase or catalytically active fragments thereof. In some embodiments, the adenosine deaminase is a TadA deaminase. In some embodiments, the TadA deaminase is a modified adenosine deaminase that does not occur in nature. In some embodiments, the cytidine base editor comprises two adenosine deaminases that are the same or different. In some embodiments, the two adenosine deaminases are capable of forming heterodimers or homodimers. In some embodiments, the adenosine deaminase domains are a wild-type TadA and TadA7.10.

In some embodiments, the adenosine deaminase comprises a deletion of the C terminus beginning at a residue selected from the group consisting of 149, 150, 151, 152, 153, 154, 155, 156, and 157. In some embodiments, the adenosine deaminase is missing 1, 2, 3, 4, 5, 6, 7, 8, 9, 10, 11, 12, 13, 14, 15, 6, 17, 18, 19, or 20 N-terminal amino acid residues relative to a full-length adenosine deaminase. In some embodiments, the adenosine deaminase is missing 1, 2, 3, 4, 5, 6, 7, 8, 9, 10, 11, 12, 13, 14, 15, 6, 17, 18, 19, or 20 C-terminal amino acid residues relative to a full-length adenosine deaminase. In some embodiments, the at least one nucleobase editor domain further comprises an abasic nucleobase editor. In some embodiments, the cytidine base editor of any one of aspects above, further comprises one or more Nuclear Localization Signals (NLS). In some embodiments, the cytidine base editor comprises an N-terminal NLS and/or a C-terminal NLS. In some embodiments, the NLS is a bipartite NLS.

In some embodiments, the polynucleotide programmable DNA binding domain is a Cas9. In some embodiments, the polynucleotide programmable DNA binding domain is a *Staphylococcus aureus* Cas9 (SaCas9), a *Streptococcus pyogenes* Cas9 (SpCas9), or variants thereof. In some embodiments, the polynucleotide programmable DNA binding domain comprises a nuclease dead Cas9 (dCas9), a Cas9 nickase (nCas9), or a nuclease active Cas9. In some embodiments, the polynucleotide programmable DNA binding domain comprises a catalytic domain capable of cleaving the reverse complement strand of the nucleic acid sequence. In some embodiments, the polynucleotide programmable DNA binding domain does not comprise a catalytic domain capable of cleaving the nucleic acid sequence. In some embodiments, the Cas9 is a dCas9. In some embodiments, the Cas9 is a Cas9 nickase (nCas9). In some embodiments, the nCas9 comprises amino acid substitution D10A or a corresponding amino acid substitution thereof.

In some embodiments, the cytidine base editor of any one of aspects above, further comprises one or more Uracil DNA glycosylase inhibitors (UGI). In some embodiments, the one or more UGI is derived from *Bacillus subtilis* bacteriophage PBS1 and inhibits human UDG activity. In some embodiments, the cytidine base editor comprises two Uracil DNA glycosylase inhibitors (UGI). In some embodiments, the cytidine base editor of any one of aspects above, further comprises one or more linkers.

Provided herein is a cell comprising the cytidine base editor of any one of aspects above. In some embodiments, the cell is a bacterial cell, plant cell, insect cell, or mammalian cell.

Provided herein is a molecular complex comprising the cytidine base editor of any one of aspects above and one or more of a guide RNA sequence, a tracrRNA sequence, or a target DNA sequence.

Provided herein is a method of editing a nucleobase of a nucleic acid sequence, the method comprising contacting the nucleic acid sequence with the cytidine base editor of any one of aspects above and converting a first nucleobase of the DNA sequence to a second nucleobase.

In some embodiments, the method further comprises contacting the nucleic acid sequence with a guide polynucleotide to effect the conversion. In some embodiments, the first nucleobase is cytosine and the second nucleobase is thymidine.

In one aspect, provided herein is a fusion protein comprising a polynucleotide programmable DNA binding domain and at least one nucleobase editor domain comprising a cytidine deaminase, wherein the cytidine deaminase is (i) an APOBEC-1 from *Mesocricetus auratus* (MaAPOBEC-1), *Pongo pygmaeus* (PpAPOBEC-1), *Oryctolagus cuniculus* (OcAPOBEC-1), *Monodelphis domestica* (MdAPOBEC-1), or *Alligator mississippiensis* (AmAPOBEC-1), (ii) an APOBEC-2 from *Pongo pygmaeus* (PpAPOBEC-2), *Bos taurus* (BtAPOBEC-2), or *Sus scrofa* (SsAPOBEC-2), (iii) an APOBEC-4 from *Macaca fascicularis* (MfAPOBEC-4), (iv) an AID from *Canis lupus* familaris (ClAID) or *Bos Taurus* (BtAID), (v) a yeast cytosine deaminase (yCD) from *Saccharomyces cerevisiae*, (vi) an APOBEC-3F from *Rhinopithecus roxellana* (RrA3F), or (vii) a cytidine deaminase having an amino acid sequence that is at least 80%, 85%, 90%, 95%, 96%, 97%, 98%, or 99% identical to any one of (i)-(viii).

In one aspect provided herein is a fusion protein comprising a polynucleotide programmable DNA binding domain and at least one nucleobase editor domain comprising a cytidine deaminase, wherein the cytidine deaminase is an APOBEC-1 from *Mesocricetus auratus* (MaAPOBEC-1), *Pongo pygmaeus* (PpAPOBEC-1), *Oryctolagus cuniculus* (OcAPOBEC-1), *Monodelphis domestica* (MdAPOBEC-1), or a cytidine deaminase having an amino acid sequence that is at least 80%, 85%, 90%, 95%, 96%, 97%, 98%, or 99% identical thereto.

In one aspect provided herein is a fusion protein comprising a polynucleotide programmable DNA binding domain and at least one nucleobase editor domain comprising a cytidine deaminase, wherein the cytidine deaminase is an APOBEC-2 from *Pongo pygmaeus* (PpAPOBEC-2), *Bos taurus* (BtAPOBEC-2), or *Sus scrofa* (SsAPOBEC-2), or a cytidine deaminase having an amino acid sequence that is at least 80%, 85%, 90%, 95%, 96%, 97%, 98%, or 99% identical thereto.

In one aspect provided herein is a fusion protein comprising a polynucleotide programmable DNA binding domain and at least one nucleobase editor domain comprising a cytidine deaminase, wherein the cytidine deaminase is an APOBEC-4 from *Macaca fascicularis* (MfAPOBEC-4), or a cytidine deaminase having an amino acid sequence that is at least 80%, 85%, 90%, 95%, 96%, 97%, 98%, or 99% identical thereto.

In one aspect provided herein is a fusion protein comprising a polynucleotide programmable DNA binding domain and at least one nucleobase editor domain comprising a cytidine deaminase, wherein the cytidine deaminase is an AID from *Canis lupus* familaris (ClAID), *Bos Taurus* (BtAID), or a cytidine deaminase having an amino acid sequence that is at least 80%, 85%, 90%, 95%, 96%, 97%, 98%, or 99% identical thereto In one aspect provided herein is a fusion protein comprising a polynucleotide programmable DNA binding domain and at least one nucleobase editor domain comprising a cytidine deaminase, wherein the cytidine deaminase is a yeast cytosine deaminase (yCD) from *Saccharomyces cerevisiae*, or a cytidine deaminase having an amino acid sequence that is at least 80%, 85%, 90%, 95%, 96%, 97%, 98%, or 99% identical thereto.

In one aspect provided herein is a fusion protein comprising a polynucleotide programmable DNA binding domain and at least one nucleobase editor domain comprising a cytidine deaminase, wherein the cytidine deaminase is an APOBEC-3F from *Rhinopithecus roxellana* (RrA3F), or a cytidine deaminase having an amino acid sequence that is at least 80%, 85%, 90%, 95%, 96%, 97%, 98%, or 99% identical thereto.

In one aspect provided herein is a fusion protein comprising a polynucleotide programmable DNA binding domain and at least one nucleobase editor domain comprising a cytidine deaminase, wherein the cytidine deaminase is any one of the cytidine deaminases provided in Table 13, or a cytidine deaminase having an amino acid sequence that is at least 80%, 85%, 90%, 95%, 96%, 97%, 98%, or 99% identical thereto.

In one aspect provided herein is a fusion protein comprising a polynucleotide programmable DNA binding domain and at least one nucleobase editor domain comprising a cytidine deaminase, wherein the cytidine deaminase is APOBEC-3F from *Rhinopithecus roxellana* (RrA3F), APOBEC-1 from *Alligator mississippiensis* (AmAPOBEC-1), APOBEC-2 from *Sus scrofa* (SsAPOBEC-2), APOBEC-1 from *Pongo pygmaeus* (PpAPOBEC-1), or a cytidine deaminase having an amino acid sequence that is at least 80%, 85%, 90%, 95%, 96%, 97%, 98%, or 99% identical thereto.

In some embodiments, the cytidine deaminase comprises one or more alterations at positions R15X, R16X, H21X, R30X, R33X, K34X, R52X, K60X, R118X, H121X, H122X, R126X, R128X, R169X, R198X, T36X, H53X, V62X, L88X, W90X, Y120X or R132X as numbered in SEQ ID NO: 1, or one or more corresponding alterations thereof, wherein X is any amino acid. In some embodiments, the cytidine deaminase comprises one or more alterations selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E as numbered in SEQ ID NO: 1, or one or more corresponding alterations thereof. In some embodiments, the cytidine deaminase comprises a combination of alterations selected from the group consisting of: K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E as numbered in SEQ ID NO: 1 or corresponding alterations thereof. In some embodiments, the cytidine deaminase comprises a combination of alterations selected from the group consisting of Y120F and one or more alterations selected from the group consisting of R33A, W90F, K34A, R52A, H122A, and H121A as numbered in SEQ ID NO: 1, or one or more corresponding alterations thereof.

In some embodiments, the cytidine deaminase comprises one or more alterations at positions Y130X or R28X as numbered in SEQ ID NO: 1, or one or more corresponding alterations thereof, wherein X is any amino acid. In some embodiments, the cytidine deaminase comprises one or more alterations selected from the group consisting of Y130A and R28A as numbered in SEQ ID NO: 1, or one or more corresponding alterations thereof. In some embodiments, the cytidine deaminase comprises alterations Y130A and R28A as numbered in SEQ ID NO: 1 or corresponding alterations thereof. In some embodiments, the cytidine deaminase comprises one or more alterations at positions H122X, K34X, R33X, W90X, or R128X as numbered in SEQ ID NO: 1, or one or more corresponding alterations thereof, wherein X is any amino acid. In some embodiments, the cytidine deaminase comprises one or more alterations selected from the group consisting of H122A, K34A, R33A, W90F, W90A, and R128A as numbered in SEQ ID NO: 1, or one or more corresponding alterations thereof.

In some embodiments, the cytidine deaminase comprises a combination of alterations selected from the group consisting of: R33A+K34A, W90F+K34A, R33A+K34A+W90F, and R33A+K34A+H122A+W90F as numbered in SEQ ID NO: 1, or one or more corresponding alterations thereof. In some embodiments, the cytidine deaminase comprises a H122A alteration as numbered in SEQ ID NO: 1, or a corresponding alteration thereof. In some embodiments, the cytidine deaminase is rAPOBEC1 and comprises one or more alterations selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E as numbered in SEQ ID NO: 1 or one or more corresponding alterations thereof. In some embodiments, the cytidine deaminase comprises a combination of alterations selected from the group consisting of: K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E as numbered in SEQ ID NO: 1 or one or more corresponding alterations thereof.

In one aspect provided herein is a fusion protein comprising a polynucleotide programmable DNA binding domain and at least one nucleobase editor domain comprising a cytidine deaminase selected from the group consisting of APOBEC2 family members, APOBEC3 family members, APOBEC4 family members, cytidine deaminase 1 family members (CDA1), A3A family members, RrA3F family members, PmCDA1 family members, and FENRY family members.

In some embodiments, the APOBEC3 family member is selected from the group consisting of APOBEC3A, APOBEC3B, APOBEC3C, APOBEC3D, APOBEC3E, APOBEC3F, APOBEC3G, and APOBEC3H. In some embodiments, the APOBEC2 family member is SsAPOBEC2.

Provided herein is a fusion protein comprising a polynucleotide programmable DNA binding domain and at least one nucleobase editor domain comprising an APOBEC1 selected from the group consisting of ppAPOBEC1, AmAPOBEC1 (BEM3.31), ocAPOBEC1, SsAPOBEC2 (BEM3.39), hAPOBEC3A, maAPOBEC1, and mdAPOBEC1.

In some embodiments, the cytidine deaminase comprises one or more alterations at positions R15X, R16X, H21X, R30X, R33X, K34X, R52X, K60X, R118X, H121X, H122X, R126X, R128X, R169X, R198X, T36X, H53X, V62X, L88X, W90X, Y120X or R132X as numbered in SEQ ID NO: 1, or one or more corresponding alterations thereof, wherein X is any amino acid. In some embodiments, the one or more alterations are selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E as numbered in SEQ ID NO: 1, or one or more corresponding alterations thereof. In some embodiments, the cytidine deaminase comprises a combination of alterations selected from the group consisting of: K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E as numbered in SEQ ID NO: 1, or one or more corresponding alterations thereof. In some embodiments, the cytidine deaminase comprises a combination of alterations selected from the group consisting of Y120F and one or more alterations selected from the group consisting of R33A, W90F, K34A, R52A, H122A, and H121A, as numbered in SEQ ID NO: 1, or one or more corresponding alterations thereof.

In one aspect provided herein is a fusion protein comprising a polynucleotide programmable DNA binding domain and at least one nucleobase editor domain comprising a cytidine deaminase, wherein the cytidine deaminase comprises one or more alterations at positions R15X, R16X, H21X, R30X, R33X, K34X, R52X, K60X, R118X, H121X, H122X, R126X, R128X, R169X, R198X, T36X, H53X, V62X, L88X, W90X, Y120X or R132X as numbered in SEQ ID NO: 1, or one or more corresponding alterations thereof, wherein X is any amino acid.

In some embodiments, the cytidine deaminase comprises one or more alterations selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E as numbered in SEQ ID NO: 1, or one or more corresponding alterations thereof. In some embodiments, the cytidine deaminase comprises a combination of alterations selected from the group consisting of: K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E as numbered in SEQ ID NO: 1, or one or more corresponding alterations thereof. In some embodiments, the cytidine deaminase comprises an alteration at position Y120F and one or more alterations selected from the group consisting of R33A, W90F, K34A, R52A, H122A, and H121A as numbered in SEQ ID NO: 1, or one or more corresponding alterations thereof.

In one aspect provided herein is a fusion protein comprising a polynucleotide programmable DNA binding domain and at least one nucleobase editor domain comprising a cytidine deaminase, wherein the cytidine deaminase comprises one or more alterations at positions Y130X and R28X as numbered in SEQ ID NO: 1, or one or more corresponding alterations thereof, wherein X is any amino acid.

In some embodiments, the cytidine deaminase comprises one or more alterations selected from the group consisting of Y130A and R28A, as numbered in SEQ ID NO: 1, or one or more corresponding alterations thereof. In some embodiments, the cytidine deaminase comprises alterations Y130A and R28A.

In one aspect provided herein is a fusion protein comprising a polynucleotide programmable DNA binding domain and at least one nucleobase editor domain comprising a cytidine deaminase, wherein the cytidine deaminase comprises one or more alterations at positions H122X, K34X, R33X, W90X, or R128X as numbered in SEQ ID NO: 1 or one or more corresponding alterations thereof, wherein X is any amino acid.

In some embodiments, the cytidine deaminase comprises one or more alterations selected from the group consisting of H122A, K34A, R33A, W90F, W90A, and R128A as numbered in SEQ ID NO: 1 or one or more corresponding alterations thereof. In some embodiments, the cytidine deaminase comprises a combination of alterations selected from the group consisting of: R33A+K34A, W90F+K34A, R33A+K34A+W90F, and R33A+K34A+H122A+W90F as numbered in SEQ ID NO: 1, or one or more corresponding alterations thereof. In some embodiments, the cytidine deaminase is selected from the group consisting of APOBEC1, APOBEC2, APOBEC3A, APOBEC3B, APOBEC3C, APOBEC3D, APOBEC3E, APOBEC3F, APOBEC3G, APOBEC3H, APOBEC4, Activation-induced (cytidine) deaminase (AID), hAPOBEC1, rAPOBEC1, ppAPOBEC1, AmAPOBEC1 (BEM3.31), ocAPOBEC1, SsAPOBEC2 (BEM3.39), hAPOBEC3A, maAPOBEC1, mdAPOBEC1, cytidine deaminase 1 (CDA1), hA3A, RrA3F (BEM3.14), PmCDA1, AID (Activation-induced cytidine deaminase; AICDA), hAID, and FENRY. In some embodiments, the cytidine deaminase is APOBEC1. In some embodiments, the cytidine deaminase is rAPOBEC1. In some embodiments, the cytidine deaminase is hAPOBEC3A. In some embodiments, the cytidine deaminase is ppAPOBEC1.

In one aspect provided herein is a fusion protein comprising a polynucleotide programmable DNA binding domain and a cytidine deaminase, wherein the cytidine deaminase comprises an amino acid sequence that has at least 80% identity to amino acid sequence:

(SEQ ID NO: 158)
MTSEKGPSTGDPTLRRRIESWEFDVFYDPRELRKETCLLYEIKWGMSRK

IWRSSGKNTTNHVEVNFIKKFTSERRFHSSISCSITWFLSWSPCWECSQ

AIREFLSQHPGVTLVIYVARLFWHMDQRNRQGLRDLVNSGVTIQIMRAS

EYYHCWRNFVNYPPGDEAHWPQYPPLWMMLYALELHCIILSLPPCLKIS

RRWQNHLAFFRLHLQNCHYQTIPPHILLATGLIHPSVTWR.

In one aspect provided herein is a fusion protein comprising a polynucleotide programmable DNA binding domain and a cytidine deaminase, wherein the cytidine deaminase comprises an amino acid sequence that has at least 80% identity to amino acid sequence:

(SEQ ID NO: 159)
MKPQIRDHRPNPMEAMYPHIFYFHFENLEKAYGRNETWLCFTVEIIKQYL

PVPWKKGVFRNQVDPETHCHAEKCFLSWFCNNTLSPKKNYQVTWYTSWSP

CPECAGEVAEFLAEHSNVKLTIYTARLYYFWDTDYQEGLRSLSEEGASVE

IMDYEDFQYCWENFVYDDGEPFKRWKGLKYNFQSLTRRLREILQ.

In one aspect provided herein is a fusion protein comprising a polynucleotide programmable DNA binding domain and a cytidine deaminase, wherein the cytidine deaminase comprises an amino acid sequence that has at least 80% identity to amino acid sequence:

(SEQ ID NO: 160)
MADSSEKMRGQYISRDTFEKNYKPIDGTKEAHLLCEIKWGKYGKPWLHWC

QNQRMNIHAEDYFMNNIFKAKKHPVHCYVTWYLSWSPCADCASKIVKFLE

ERPYLKLTIYVAQLYYHTEEENRKGLRLLRSKKVIIRVMDISDYNYCWKV

FVSNQNGNEDYWPLQFDPWVKENYSRLLDIFWESKCRSPNPW.

In one aspect provided herein is a fusion protein comprising a polynucleotide programmable DNA binding domain and a cytidine deaminase, wherein the cytidine deaminase comprises an amino acid sequence that has at least 80% identity to amino acid sequence:

(SEQ ID NO: 161)
MDPQRLRQWPGPGPASRGGYGQRPRIRNPEEWFHELSPRTFSFHFRNLRF

ASGRNRSYICCQVEGKNCFFQGIFQNQVPPDPPCHAELCFLSWFQSWGLS

PDEHYYVTWFISWSPCCECAAKVAQFLEENRNVSLSLSAARLYYFWKSES

REGLRRLSDLGAQVGIMSFQDFQHCWNNFVHNLGMPFQPWKKLHKNYQRL

-continued

```
VTELKQILREEPATYGSPQAQGKVRIGSTAAGLRHSHSHTRSEAHLRPNH

SSRQHRILNPPREARARTCVLVDASWICYR.
```

In some embodiments, the cytidine deaminase comprises a H122A alteration.

In one aspect provided herein is a fusion protein comprising a polynucleotide programmable DNA binding domain and a cytidine deaminase, wherein the cytidine deaminase is an APOBEC1 deaminase and comprises a H122A alteration.

In one aspect provided herein is a fusion protein comprising a polynucleotide programmable DNA binding domain and a cytidine deaminase, wherein the cytidine deaminase is rAPOBEC1 and comprises one or more alterations selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E. In some embodiments, the cytidine deaminase comprises a combination of alterations selected from the group consisting of: K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E.

In one aspect provided herein is a fusion protein comprising a polynucleotide programmable DNA binding domain and at least one nucleobase editor domain comprising an APOBEC1 selected from the group consisting of ppAPOBEC1, AmAPOBEC1 (BEM3.31), ocAPOBEC1, SsAPOBEC2 (BEM3.39), hAPOBEC3A, maAPOBEC1, and mdAPOBEC1.

In some embodiments, the APOBEC1 comprises one or more alterations at positions R15X, R16X, H21X, R30X, R33X, K34X, R52X, K60X, R118X, H121X, H122X, R126X, R128X, R169X, R198X, T36X, H53X, V62X, L88X, W90X, Y120X or R132X as numbered in SEQ ID NO: 1 or one or more corresponding alterations thereof, wherein X is any amino acid.

In some embodiments, the one or more alterations are selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E as numbered in SEQ ID NO: 1, or one or more corresponding alterations thereof. In some embodiments, the APOBEC1 comprises a combination of alterations selected from the group consisting of: K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E as numbered in SEQ ID NO: 1 or one or more corresponding alterations thereof. In some embodiments, the APOBEC1 comprises an alteration at Y120F and one or more alterations selected from the group consisting of R33A, W90F, K34A, R52A, H122A, and H121A as numbered in SEQ ID NO: 1, or one or more corresponding alterations thereof.

In some embodiments, the fusion protein of any one of aspects above, further comprises at least one adenosine deaminase or catalytically active fragments thereof. In some embodiments, the adenosine deaminase is a TadA deaminase. In some embodiments, the TadA deaminase is a modified adenosine deaminase that does not occur in nature. In some embodiments, the fusion protein comprises two adenosine deaminases that are the same or different. In some embodiments, the two adenosine deaminases are capable of forming heterodimers or homodimers. In some embodiments, the two adenosine deaminase domains are a wild-type TadA and TadA7.10.

In some embodiments, the adenosine deaminase comprises a deletion of the C terminus beginning at a residue selected from the group consisting of 149, 150, 151, 152, 153, 154, 155, 156, and 157. In some embodiments, the adenosine deaminase is missing 1, 2, 3, 4, 5, 6, 7, 8, 9, 10, 11, 12, 13, 14, 15, 6, 17, 18, 19, or 20 N-terminal amino acid residues relative to a full-length adenosine deaminase. In some embodiments, the adenosine deaminase is missing 1, 2, 3, 4, 5, 6, 7, 8, 9, 10, 11, 12, 13, 14, 15, 6, 17, 18, 19, or 20 C-terminal amino acid residues relative to a full-length adenosine deaminase. In some embodiments, the at least one nucleobase editor domain further comprises an abasic nucleobase editor.

In some embodiments, the fusion protein of any one of aspects above, further comprises one or more Nuclear Localization Signals (NLS). In some embodiments, the fusion protein comprises an N-terminal NLS and/or a C-terminal NLS. In some embodiments, the NLS is a bipartite NLS.

In some embodiments, the polynucleotide programmable DNA binding domain is Cas9. In some embodiments, the polynucleotide programmable DNA binding domain is a *Staphylococcus aureus* Cas9 (SaCas9), a *Streptococcus pyogenes* Cas9 (SpCas9), or variants thereof. In some embodiments, the polynucleotide programmable DNA binding domain comprises a nuclease dead Cas9 (dCas9), a Cas9 nickase (nCas9), or a nuclease active Cas9. In some embodiments, the polynucleotide programmable DNA binding domain comprises a catalytic domain capable of cleaving the reverse complement strand of the nucleic acid sequence. In some embodiments, the polynucleotide programmable DNA binding domain does not comprise a catalytic domain capable of cleaving the nucleic acid sequence.

In some embodiments, the Cas9 is dCas9. In some embodiments, the Cas9 is a Cas9 nickase (nCas9). In some embodiments, the nCas9 comprises amino acid substitution D10A or a corresponding amino acid substitution thereof. In some embodiments, the fusion protein of any one of aspects above, further comprises one or more Uracil DNA glycosylase inhibitors (UGI). In some embodiments, the one or more UGI is derived from *Bacillus subtilis* bacteriophage PBS1 and inhibits human UDG activity. In some embodiments, the fusion protein comprises two Uracil DNA glycosylase inhibitors (UGI). In some embodiments, the fusion protein of any one of aspects above, further comprises one or more linkers. In some embodiments, the fusion protein deaminates a nucleobase in a target nucleotide sequence, and wherein the deamination has an increased ratio of in cis to in trans activity (in cis:in trans) as compared to a standard cytidine base editor.

In some embodiments, the standard cytidine base editor comprises (i) a polynucleotide programmable DNA binding domain and (ii) an APOBEC cytidine deaminase.

In some embodiments, the APOBEC cytidine deaminase of the standard cytidine base editor is a rat APOBEC-1 cytidine deaminase (rAPOBEC-1). In some embodiments, the polynucleotide programmable DNA binding domain of the standard cytidine base editor is a Cas9 nickase. In some embodiments, the standard cytidine base editor comprises a uracil glycosylase inhibitor (UGI) domain. In some embodiments, the standard cytidine base editor is a BE3 or BE4. In some embodiments, the increased ratio of in cis to in trans activity is increased by at least 2, 2.5, 5, 10, 15, 20, 25, 30, 35, 40, 45, 50, 60 fold or more. In some embodiments, the cytidine base editor has at least 50%, 60%, 70%, 80%, 90%, 95%, 100%, 105%, 110%, 115%, 120%, or more in cis activity as compared to the standard cytidine base editor. In some embodiments, the cytidine base editor has at least 2, 5, 10, 15, 20, 25, 30, 35, 40, 45, 50, 60, or more fold less in trans activity as compared to the standard cytidine base editor.

In one aspect provided herein is a polynucleotide molecule encoding the fusion protein of any one of aspects above. In some embodiments, the polynucleotide is codon optimized.

Provided herein is an expression vector comprising a polynucleotide molecule described above. In some embodiments, the expression vector is a mammalian expression vector. In some embodiments, the vector is a viral vector selected from the group consisting of adeno-associated virus (AAV), retroviral vector, adenoviral vector, lentiviral vector, Sendai virus vector, and herpesvirus vector. In some embodiments, the vector comprises a promoter.

Provided herein is a cell comprising the polynucleotide described above or the vector described above. In some embodiments, the cell is a bacterial cell, plant cell, insect cell, a human cell, or mammalian cell.

Provided herein is a molecular complex comprising the fusion protein of any one of aspects above and one or more of a guide RNA sequence, a tracrRNA sequence, or a target DNA sequence.

Provided herein a kit comprising the fusion protein of any one of aspects above, the polynucleotide described above, the vector described above, or the molecular complex described above.

Provided herein is a method of editing a nucleobase of a nucleic acid sequence, the method comprising contacting a nucleic acid sequence with a base editor comprising: the fusion protein of any one of aspects above and converting a first nucleobase of the DNA sequence to a second nucleobase. In some embodiments, the first nucleobase is cytosine and the second nucleobase is thymidine.

Provided herein is a method of editing a nucleobase of a nucleic acid sequence, the method comprising contacting a nucleic acid sequence with a base editor comprising: the fusion protein of any one of aspects above and converting a first nucleobase of the DNA sequence to a second nucleobase. In some embodiments, the first nucleobase is cytosine and the second nucleobase is thymidine or the first nucleobase is adenine and the second nucleobase is guanine. In some embodiments, the method further comprises converting a third to a fourth nucleobase. In some embodiments, the third nucleobase is guanine and the fourth nucleobase is adenine or the third nucleobase is thymine and the fourth nucleobase is cytosine.

Provided herein is a method for optimized base editing, the method comprising: contacting a target nucleobase in a target nucleotide sequence with a cytidine base editor comprising (i) a polynucleotide programmable DNA binding domain and (ii) a cytidine deaminase, wherein the cytidine base editor deaminates the target nucleobase with lower spurious deamination in the target nucleotide sequence as compared to a canonical cytidine base editor comprising a rAPOBEC1. In some embodiments, the cytidine base editor deaminates the target nucleobase at higher efficiency as compared to the canonical cytidine base editor. In some embodiments, the canonical cytidine base editor further comprises a uracil glycosylase inhibitor (UGI) domain. In some embodiments, the canonical cytidine base editor is a BE3 or BE4. In some embodiments, the cytidine base editor generates at least 20%, 30%, 50%, 70%, or 90% lower spurious deamination as compared to the canonical cytidine base editor as measured by an in cis/in trans deamination assay. In some embodiments, the cytidine base editor has at least 50%, 60%, 70%, 80%, 90%, 95%, 100%, 105%, 110%, 115%, 120%, or more in cis activity as compared to the canonical cytidine base editor. In some embodiments, the cytidine base editor has at least 2, 5, 10, 15, 20, 25, 30, 35, 40, 45, 50, 60, or more fold less in trans activity as compared to the canonical cytidine base editor. In some embodiments, the cytidine deaminase is (a) an APOBEC-1 from *Mesocricetus auratus* (MaAPOBEC-1), *Pongo pygmaeus* (PpAPOBEC-1), *Oryctolagus* cuniculus (OcAPOBEC-1), *Monodelphis domestica* (MdAPOBEC-1), or *Alligator mississippiensis* (AmAPOBEC-1), (b) an APOBEC-2 from *Pongo pygmaeus* (PpAPOBEC-2), *Bos taurus* (BtAPOBEC-2), or *Sus scrofa* (SsAPOBEC-2), (c) an APOBEC-4 from *Macaca fascicularis* (MfAPOBEC-4), (d) an AID from *Canis lupus* familaris (ClAID) or *Bos Taurus* (BtAID), (e) a yeast cytosine deaminase (yCD) from *Saccharomyces cerevisiae*, (f) an APOBEC-3F from *Rhinopithecus roxellana* (RrA3F), or (g) a cytidine deaminase having an amino acid sequence that is at least 80%, 85%, 90%, 95%, 96%, 97%, 98%, or 99% identical to any one of (a)-(f).

In some embodiments, the cytidine deaminase is an AID from *Canis lupus* familaris (ClAID), *Bos Taurus* (BtAID), or a cytidine deaminase having an amino acid sequence that is at least 80%, 85%, 90%, 95%, 96%, 97%, 98%, or 99% identical thereto. In some embodiments, the cytidine deaminase is an APOBEC-3F from *Rhinopithecus roxellana* (RrA3F), or a cytidine deaminase having an amino acid sequence that is at least 80%, 85%, 90%, 95%, 96%, 97%, 98%, or 99% identical thereto.

In some embodiments, the cytidine deaminase comprises an alteration selected from the group consisting of R15X, R16X, H21X, R30X, R33X, K34X, R52X, K60X, R118X, H121X, H122X, R126X, R128X, R169X, R198X, T36X, H53X, V62X, L88X, W90X, Y120X, and R132X as numbered in SEQ ID NO: 1 or a corresponding alteration thereof, wherein X is any amino acid. In some embodiments, the cytidine deaminase comprises an alteration selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E as numbered in SEQ ID NO: 1 or a corresponding alteration thereof.

In some embodiments, the cytidine deaminase comprises a combination of alterations selected from the group consisting of: K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E as numbered in SEQ ID NO: 1 or a corresponding cobinatino of alterations thereof.

In some embodiments, the cytidine deaminase comprises an alteration at position Y120F and one or more alterations selected from the group consisting of R33A, W90F, K34A, R52A, H122A, and H121A as numbered in SEQ ID NO: 1, or one or more corresponding alterations thereof. In some embodiments, the cytidine deaminase comprises an alterations at position Y130X or R28X as numbered in SEQ ID NO: 1 or a corresponding alteration thereof, wherein X is any amino acid. In some embodiments, the cytidine deaminase comprises an Y130A alteration or a R28A alteration as numbered in SEQ ID NO: 1 or a corresponding alteration thereof. In some embodiments, the cytidine deaminase comprises alterations Y130A and R28A as numbered in SEQ ID NO: 1 or corresponding alterations thereof.

In some embodiments, the cytidine deaminase comprises an alteration at positions H122X, K34X, R33X, W90X, and R128X as numbered in SEQ ID NO: 1 or a corresponding alterations thereof, wherein X is any amino acid. In some embodiments, the cytidine deaminase comprises an alteration selected from the group consisting of H122A, K34A, R33A, W90F, W90A, and R128A as numbered in SEQ ID NO: 1, or a corresponding alteration thereof. In some embodiments, the cytidine deaminase comprises a combination of alterations selected from the group consisting of: R33A+K34A, W90F+K34A, R33A+K34A+W90F, and R33A+K34A+H122A+W90F as numbered in SEQ ID NO: 1 or a corresponding combination of alterations thereof.

In some embodiments, the cytidine deaminase comprises an amino acid sequence that has at least 80% identity to amino acid sequence:

(SEQ ID NO: 154)
MTSEKGPSTGDPTLRRRIESWEFDVFYDPRELRKETCLLYEIKWGMSRKI
WRSSGKNTTNHVEVNFIKKFTSERRFHSSISCSITWFLSWSPCWECSQAI
REFLSQHPGVTLVIYVARLFWHMDQRNRQGLRDLVNSGVTIQIMRASEYY
HCWRNFVNYPPGDEAHWPQYPPLWMMLYALELHCIILSLPPCLKISRRWQ
NHLAFFRLHLQNCHYQTIPPHILLATGLIHPSVTWR.

In some embodiments, the cytidine deaminase comprises an amino acid sequence that has at least 80% identity to amino acid sequence:

(SEQ ID NO: 155)
MKPQIRDHRPNPMEAMYPHIFYFHFENLEKAYGRNETWLCFTVEIIKQYL
PVPWKKGVFRNQVDPETHCHAEKCFLSWFCNNTLSPKKNYQVTWYTSWSP
CPECAGEVAEFLAEHSNVKLTIYTARLYYFWDTDYQEGLRSLSEEGASVE
IMDYEDFQYCWENFVYDDGEPFKRWKGLKYNFQSLTRRLREILQ.

In some embodiments, the cytidine deaminase comprises an amino acid sequence that has at least 80% identity to amino acid sequence:

(SEQ ID NO: 156)
MADSSEKMRGQYISRDTFEKNYKPIDGTKEAHLLCEIKWGKYGKPWLHWC
QNQRMNIHAEDYFMNNIFKAKKHPVHCYVTWYLSWSPCADCASKIVKFLE
ERPYLKLTIYVAQLYYHTEEENRKGLRLLRSKKVIIRVMDISDYNYCWKV
FVSNQNGNEDYWPLQFDPWVKENYSRLLDIFWESKCRSPNPW.

In some embodiments, the cytidine deaminase comprises an amino acid sequence that has at least 80% identity to amino acid sequence:

(SEQ ID NO: 157)
MDPQRLRQWPGPGPASRGGYGQRPRIRNPEEWFHELSPRTFSFHFRNLRF
ASGRNRSYICCQVEGKNCFFQGIFQNQVPPDPPCHAELCFLSWFQSWGLS
PDEHYYVTWFISWSPCCECAAKVAQFLEENRNVSLSLSAARLYYFWKSES
REGLRRLSDLGAQVGIMSFQDFQHCWNNFVHNLGMPFQPWKKLHKNYQRL

-continued

VTELKQILREEPATYGSPQAQGKVRIGSTAAGLRHSHSHTRSEAHLRPNH
SSRQHRILNPPREARARTCVLVDASWICYR.

In some embodiments, the cytidine deaminase comprises a H122A alteration. In some embodiments, the contacting is performed in a cell. In some embodiments, the cell is a human cell or a mammalian cell. In some embodiments, the contacting is in vivo or ex vivo.

In one aspect provided herein is a cytidine deaminase comprising an amino acid sequence that has at least 80% identity to an amino acid sequence selected from (SEQ ID NO: 154)
MTSEKGPSTGDPTLRRRIESWEFDVFYDPRELRKETCLLYEIKWGMSRKI
WRSSGKNTTNHVEVNFIKKFTSERRFHSSISCSITWFLSWSPCWECSQAI
REFLSQHPGVTLVIYVARLFWHMDQRNRQGLRDLVNSGVTIQIMRASEYY
HCWRNFVNYPPGDEAHWPQYPPLWMMLYALELHCIILSLPPCLKISRRWQ
NHLAFFRLHLQNCHYQTIPPHILLATGLIHPSVTWR;

(SEQ ID NO: 155)
MKPQIRDHRPNPMEAMYPHIFYFHFENLEKAYGRNETWLCFTVEIIKQYL
PVPWKKGVFRNQVDPETHCHAEKCFLSWFCNNTLSPKKNYQVTWYTSWSP
CPECAGEVAEFLAEHSNVKLTIYTARLYYFWDTDYQEGLRSLSEEGASVE
IMDYEDFQYCWENFVYDDGEPFKRWKGLKYNFQSLTRRLREILQ;

(SEQ ID NO: 156)
MADSSEKMRGQYISRDTFEKNYKPIDGTKEAHLLCEIKWGKYGKPWLHWC
QNQRMNIHAEDYFMNNIFKAKKHPVHCYVTWYLSWSPCADCASKIVKFLE
ERPYLKLTIYVAQLYYHTEEENRKGLRLLRSKKVIIRVMDISDYNYCWKV
FVSNQNGNEDYWPLQFDPWVKENYSRLLDIFWESKCRSPNPW;
and (SEQ ID NO: 157)
MDPQRLRQWPGPGPASRGGYGQRPRIRNPEEWFHELSPRTFSFHFRNLRF
ASGRNRSYICCQVEGKNCFFQGIFQNQVPPDPPCHAELCFLSWFQSWGLS
PDEHYYVTWFISWSPCCECAAKVAQFLEENRNVSLSLSAARLYYFWKSES
REGLRRLSDLGAQVGIMSFQDFQHCWNNFVHNLGMPFQPWKKLHKNYQRL
VTELKQILREEPATYGSPQAQGKVRIGSTAAGLRHSHSHTRSEAHLRPNH
SSRQHRILNPPREARARTCVLVDASWICYR.

The description and examples herein illustrate embodiments of the present disclosure in detail. It is to be understood that this disclosure is not limited to the particular embodiments described herein and as such can vary. Those of skill in the art will recognize that there are numerous variations and modifications of this disclosure, which are encompassed within its scope.

The practice of some embodiments disclosed herein employ, unless otherwise indicated, conventional techniques of immunology, biochemistry, chemistry, molecular biology, microbiology, cell biology, genomics and recombinant DNA, which are within the skill of the art. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)).

The section headings used herein are for organizational purposes only and are not to be construed as limiting the subject matter described.

Although various features of the present disclosure can be described in the context of a single embodiment, the features can also be provided separately or in any suitable combination. Conversely, although the present disclosure can be described herein in the context of separate embodiments for clarity, the present disclosure can also be implemented in a single embodiment. The section headings used herein are for organizational purposes only and are not to be construed as limiting the subject matter described.

The features of the present disclosure are set forth with particularity in the appended claims. A better understanding of the features and advantages of the present will be obtained by reference to the following detailed description that sets forth illustrative embodiments, in which the principles of the disclosure are utilized, and in view of the accompanying drawings as described hereinbelow.

Definitions

The following definitions supplement those in the art and are directed to the current application and are not to be imputed to any related or unrelated case, e.g., to any commonly owned patent or application. Although any methods and materials similar or equivalent to those described herein can be used in the practice for testing of the present disclosure, the preferred materials and methods are described herein. Accordingly, the terminology used herein is for the purpose of describing particular embodiments only, and is not intended to be limiting.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991).

In this application, the use of the singular includes the plural unless specifically stated otherwise. It must be noted that, as used in the specification, the singular forms "a," "an," and "the" include plural references unless the context clearly dictates otherwise. In this application, the use of "or" means "and/or," unless stated otherwise, and is understood to be inclusive. Furthermore, use of the term "including" as well as other forms, such as "include," "includes," and "included," is not limiting.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, such as within 5-fold or within 2-fold, of a value. Where particular values are described in the application and claims, unless otherwise stated the term "about" meaning within an acceptable error range for the particular value should be assumed.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures.

By "abasic base editor" is meant an agent capable of excising a nucleobase and inserting a DNA nucleobase (A, T, C, or G). Abasic base editors comprise a nucleic acid glycosylase polypeptide or fragment thereof. In one embodiment, the nucleic acid glycosylase is a mutant human uracil DNA glycosylase comprising an Asp at amino acid 204 (e.g., replacing an Asn at amino acid 204) in the following sequence, or corresponding position in a uracil DNA glycosylase, and having cytosine-DNA glycosylase activity, or active fragment thereof. In one embodiment, the nucleic acid glycosylase is a mutant human uracil DNA glycosylase comprising an Ala, Gly, Cys, or Ser at amino acid 147 (e.g., replacing a Tyr at amino acid 147) in the following sequence, or corresponding position in a uracil DNA glycosylase, and having thymine-DNA glycosylase activity, or an active fragment thereof. The sequence of exemplary human uracil-DNA glycosylase, isoform 1, follows:

```
                                                         (SEQ ID NO: 162)
  1 mgvfclgpwg lgrklrtpgk gplqllsrlc gdhlqaipak kapagqeepg tppssplsae

 61 qldrigrnka aallrlaarn vpvgfgeswk khlsgefgkp yfiklmgfva eerkhytvyp

121 pphqvftwtq mcdikdvkvv ilgqdpyhgp nqahglcfsv grpvppppsl eniykelstd

181 iedfvhpghg dlsgwakqgv lllnavltvr ahqanshker gweqftdavv swlnqnsngl
```

-continued

```
241 vfllwgsyaq kkgsaidrkr hhvlqtahps plsvyrgffg crhfsktnel lqksgkkpid

301 wkel
```

The sequence of human uracil-DNA glycosylase, isoform 2, follows:

```
                                                (SEQ ID NO: 163)
  1 migqktlysf fspsparkrh apspepavqg tgvagvpees gdaaaipakk apagqeepgt

 61 ppssplsaeq ldriqrnkaa allrlaarnv pvgfgeswkk hlsgefgkpy fiklmgfvae

121 erkhytvypp phqvftwtqm cdikdvkvvi lgqdpyhgpn qahglcfsvg rpvppppsle

181 niykelstdi edfvhpghgd lsgwakqgvl llnavltvra hqanshkerg weqftdavvs

241 wlnqnsnglv fllwgsyaqk kgsaidrkrh hvlqtahpsp lsvyrgffgc rhfsktnell

301 qksgkkpidw kel
```

In other embodiments, the abasic editor is any one of the abasic editors described in PCT/JP2015/080958 and US20170321210, which are incorporated herein by reference. In particular embodiments, the abasic editor comprises a mutation at a position shown in the sequence above in bold with underlining or at a corresponding amino acid in any other abasic editor or uracil deglycosylase known in the art. In one embodiment, the abasic editor comprises a mutation at Y147, N204, L272, and/or R276, or corresponding position. In another embodiment, the abasic editor comprises a Y147A or Y147G mutation, or corresponding mutation. In another embodiment, the abasic editor comprises a N204D mutation, or corresponding mutation. In another embodiment, the abasic editor comprises a L272A mutation, or corresponding mutation. In another embodiment, the abasic editor comprises a R276E or R276C mutation, or corresponding mutation.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g., engineered adenosine deaminases, evolved adenosine deaminases) provided herein may be from any organism, such as a bacterium.

In some embodiments, the adenosine deaminase is a TadA deaminase. In some embodiments, the TadA deaminase is TadA variant. In some embodiments, the TadA variant is a TadA*7.10. In some embodiments, the deaminase or deaminase domain is a variant of a naturally occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, or at least 99.9% identical to a naturally occurring deaminase. For example, deaminase domains are described in International PCT Application Nos. PCT/2017/045381 (WO 2018/027078) and PCT/US2016/058344 (WO 2017/070632), each of which is incorporated herein by reference for its entirety. Also, see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017)), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

In some embodiments, the adenosine deaminase comprises an alteration in the following sequence:

```
                                      (SEQ ID NO: 164)
MSEVEFSHEY WMRHALTLAK RARDEREVPV GAVLVLNNRV

IGEGWNRAIG LHDPTAHAEI MALRQGGLVM QNYRLIDATL

YVTFEPCVMC AGAMIHSRIG RVVFGVRNAK TGAAGSLMDV

LHYPGMNHRV EITEGILADE CAALLCYFFR MPRQVFNAQK

KAQSSTD
(also turned TacIA*7.10).
```

In particular embodiments, an adenosine deaminase heterodimer comprises an TadA*7.10 domain and an adenosine deaminase domain selected from one of the following:

*Staphylococcus aureus* (*S. aureus*) TadA:

```
                                              (SEQ ID NO: 165)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

RVVYGADDPKGGCSGSLMNLLQQSNFNHRAIVDKGVLKEACSTLLTTFFK

NLRANKKSTN
```

*Bacillus subtilis* (*B. subtilis*) TadA:

```
                                              (SEQ ID NO: 166)
MTQDELYMKEAIKEAKKAEEKGEVPIGAVLVINGEIIARAHNLRETEQRS

IAHAEMLVIDEACKALGTWRLEGATLYVTLEPCPMCAGAVVLSRVEKVVF
```

-continued

GAFDPKGGCSGTLMNLLQEERFNHQAEVVSGVLEEECGGMLSAFFRELRK

KKKAARKNLSE

*Salmonella typhimurium* (*S. typhimurium*) TadA:
(SEQ ID NO: 167)
MPPAFITGVTSLSDVELDHEYWMRHALTLAKRAWDEREVPVGAVLVHNHR

VIGEGWNRPIGRHDPTAHAEIMALRQGGLVLQNYRLLDTTLYVTLEPCVM

CAGAMVHSRIGRVVFGARDAKTGAAGSLIDVLHHPGMNHRVEIIEGVLRD

ECATLLSDFFRMRRQEIKALKKADRAEGAGPAV

*Shewanella putrefaciens* (*S. putrefaciens*) TadA:
(SEQ ID NO: 168)
MDEYWMQVAMQMAEKAEAAGEVPVGAVLVKDGQQIATGYNLSISQHDPTA

HAEILCLRSAGKKLENYRLLDATLYITLEPCAMCAGAMVHSRIARVVYGA

RDEKTGAAGTVVNLLQHPAFNHQVEVTSGVLAEACSAQLSRFFKRRRDEK

KALKLAQRAQQGIE

*Haemophilus influenzae* F3031 (*H. influenzae*) TadA:
(SEQ ID NO: 169)
MDAAKVRSEFDEKMMRYALELADKAEALGEIPVGAVLVDDARNIIGEGWN

LSIVQSDPTAHAEIIALRNGAKNIQNYRLLNSTLYVTLEPCTMCAGAILH

SRIKRLVFGASDYKTGAIGSRFHFFDDYKMNHTLEITSGVLAEECSQKLS

TFFQKRREEKKIEKALLKSLSDK

*Caulobacter crescentus* (*C. crescentus*) TadA:
(SEQ ID NO: 170)
MRTDESEDQDHRMMRLALDAARAAAEAGETPVGAVILDPSTGEVIATAGN

GPIAAHDPTAHAEIAAMRAAAAKLGNYRLTDLTLVVTLEPCAMCAGAISH

ARIGRVVFGADDPKGGAVVHGPKFFAQPTCHWRPEVTGGVLADESADLLR

GFFRARRKAKI

*Geobacter sulfurreducens* (*G. sulfurreducens*) TadA:
(SEQ ID NO: 171)
MSSLKKTPIRDDAYWMGKAIREAAKAAARDEVPIGAVIVRDGAVIGRGHN

LREGSNDPSAHAEMIAIRQAARRSANWRLTGATLYVTLEPCLMCMGAIIL

ARLERVVFGCYDPKGGAAGSLYDLSADPRLNHQVRLSPGVCQEECGTMLS

DFFRDLRRRKKAKATPALFIDERKVPPEP

TadA*7.10
(SEQ ID NO: 164)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD

"Administering" is referred to herein as providing one or more compositions described herein to a patient or a subject. By way of example and without limitation, composition administration, e.g., injection, can be performed by intravenous (i.v.) injection, sub-cutaneous (s.c.) injection, intradermal (i.d.) injection, intraperitoneal (i.p.) injection, or intramuscular (i.m.) injection. One or more such routes can be employed. Parenteral administration can be, for example, by bolus injection or by gradual perfusion over time. In some embodiments, parenteral administration includes infusing or injecting intravascularly, intravenously, intramuscularly, intraarterially, intrathecally, intratumorally, intradermally, intraperitoneally, transtracheally, subcutaneously, subcuticularly, intraarticularly, subcapsularly, subarachnoidly and intrasternally. Alternatively, or concurrently, administration can be by an oral route.

By "agent" is meant any small molecule chemical compound, antibody, nucleic acid molecule, or polypeptide, or fragments thereof.

By "alteration" is meant a change (e.g. increase or decrease) in the structure, expression levels or activity of a gene or polypeptide as detected by standard art known methods such as those described herein. As used herein, an alteration includes a change in a polynucleotide or polypeptide sequence or a change in expression levels, such as a 10% change, a 25% change, a 40% change, a 50% change, or greater.

By "ameliorate" is meant decrease, suppress, attenuate, diminish, arrest, or stabilize the development or progression of a disease.

By "analog" is meant a molecule that is not identical, but has analogous functional or structural features. For example, a polynucleotide or polypeptide analog retains the biological activity of a corresponding naturally-occurring polynucleotide or polypeptide, while having certain modifications that enhance the analog's function relative to a naturally occurring polynucleotide or polypeptide. Such modifications could increase the analog's affinity for DNA, efficiency, specificity, protease or nuclease resistance, membrane permeability, and/or half-life, without altering, for example, ligand binding. An analog may include an unnatural nucleotide or amino acid.

By "base editor (BE)" or "nucleobase editor (NBE)" is meant an agent that binds a polynucleotide and has nucleobase modifying activity. In various embodiments, the base editor comprises a nucleobase modifying polypeptide (e.g., a deaminase) and a nucleic acid programmable nucleotide binding domain in conjunction with a guide polynucleotide (e.g., guide RNA). In various embodiments, the agent is a biomolecular complex comprising a protein domain having base editing activity, i.e., a domain capable of modifying a base (e.g., A, T, C, G, or U) within a nucleic acid molecule (e.g., DNA). In some embodiments, the polynucleotide programmable DNA binding domain is fused or linked to one or more deaminase domains. In one embodiment, the agent is a fusion protein comprising one or more domains having base editing activity. In another embodiment, the protein domains having base editing activity are linked to the guide RNA (e.g., via an RNA binding motif on the guide RNA and an RNA binding domain fused to the deaminase). In some embodiments, the domains having base editing activity are capable of deaminating a base within a nucleic acid molecule. In some embodiments, the base editor is capable of deaminating one or more bases within a DNA molecule. In some embodiments, the base editor is capable of deaminating a cytosine (C) or an adenosine (A) within DNA. In some embodiments, the base editor is capable of deaminating a cytosine (C) and an adenosine (A) within DNA. In some embodiments, the base editor is capable of deaminating a cytosine (C) within DNA. In some embodiments, the base editor is a cytidine base editor (CBE) (e.g., BE4). In some embodiments, the base editor is capable of deaminating an adenosine (A) within DNA. In some embodiments, the base editor is a standard base editor that comprises naturally occurring protein domains that have base editing activity and/or programmable DNA binding activity. For example, a standard cytidine base editor may contain a cytidine deaminase, e.g. an APOBEC cytidine deaminase or an AID deaminase. In some embodiments, the standard cytidine deaminase contains an APOBEC1 cytdine deaminase, e.g. a rAPOBEC1. In some embodiments, the standard cytidine base editor further comprises additional domains associated or linked to the cytidine deaminase, for example, one or more UGI domains may be linked or to the cytindine deaminase. In some embodiments, the base editor is an adenosine base editor (ABE) and a cytidine base editor (CBE).

In some embodiments, the base editor is a nuclease-inactive Cas9 (dCas9) fused to an adenosine deaminase and/or cytidine deaminase. In some embodiments, the Cas9 is a circular permutant Cas9 (e.g., spCas9 or saCas9). Circular permutant Cas9s are known in the art and described, for example, in Oakes et al., Cell 176, 254-267, 2019. In some embodiments, the base editor is fused to an inhibitor of base excision repair, for example, a UGI domain, or a dISN domain. In some embodiments, the fusion protein comprises a Cas9 nickase fused to one or more deaminases and an inhibitor of base excision repair, such as a UGI or dISN domain. In other embodiments the base editor is an abasic base editor.

In some embodiments, adenosine base editors are generated by cloning an adenosine deaminase variant into a scaffold that includes a circular permutant Cas9 (e.g., spCAS9 or saCAS9) and a bipartite nuclear localization sequence. Circular permutant Cas9s are known in the art and described, for example, in Oakes et al., Cell 176, 254-267, 2019. Exemplary circular permutants follow where the bold sequence indicates sequence derived from Cas9, the italics sequence denotes a linker sequence, and the underlined sequence denotes a bipartite nuclear localization sequence.

CP5 (with MSP "NGC = Pam Variant with mutations Regular Cas9 likes NGG" PID = Protein Interacting Domain and "D10A" nickase):

(SEQ ID NO: 172)*

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFMQPTVAYSVLVVAKVEKGKSKKLKSVKELLGITIMERSSFEKN

PIDFLEAKGYKEVKKDLIIKLPKYSLFELENGRKRMLASAKFLQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPRAFKYF

DTTIARKEYRSTKEVLDATLIHQSITGLYETRIDLSQLGGD*GGSGGSGGS*

*GGSGGSGGSGGM*DKKYSIGLAIGTNSVGWAVITDEYKVPSKKFKVLGNTD

RHSIKKNLIGALLFDSGETAEATRLKRTARRRYTRRKNRICYLQEIFSNE

MAKVDDSFFHRLEESFLVEEDKKHERHPIFGNIVDEVAYHEKYPTIHLRK

KLVDSTDKADLRLIYLALAHMIKFRGHFLIEGDLNPDNSDVDKLFIQLVQ

TYNQLFEENPINASGVDAKAILSARLSKSRRLENLIAQLPGEKKNGLFGN

LIALSLGLTPNFKSNFDLAEDAKLQLSKDTYDDDLDNLLAQIGDQYADLF

LAAKNLSDAILLSDILRVNTEITKAPLSASMIKRYDEHHQDLTLLKALVR

QQLPEKYKEIFFDQSKNGYAGYIDGGASQEEFYKFIKPILEKMDGTEELL

VKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNAS

-continued

LGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFAN

RNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKE

LGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAK

LITQRKFDNLTKAERGGLSELDKAGFIKRQLVETRQITKHVAQILDSRMN

TKYDENDKLIREVKVITLKSKLVSDFRKDFQFYKVREINNYHHAHDAYLN

AVVGTALIKKYPKLESEFVYGDYKVYDVRKMIAKSEQEGADKRTADGSEF

ESPKKKRKV

In some embodiments, the polynucleotide programmable DNA binding domain is a CRISPR associated (e.g., Cas or Cpf1) enzyme. In some embodiments, the base editor is a catalytically dead Cas9 (dCas9) fused to one or more deaminase domains. In some embodiments, the base editor is a Cas9 nickase (nCas9) fused to one or more deaminase domains. In some embodiments, the base editor is fused to an inhibitor of base excision repair (BER). In some embodiments, the inhibitor of base excision repair is a uracil DNA glycosylase inhibitor (UGI). In some embodiments, the inhibitor of base excision repair is an inosine base excision repair inhibitor.

Details of base editors are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By way of example, the adenine base editor (ABE) as used in the base editing compositions, systems and methods described herein has the nucleic acid sequence (8877 base pairs), (Addgene, Watertown, M A.; Gaudelli N M, et al., Nature. 2017 Nov. 23; 551(7681):464-471. doi: 10.1038/nature24644; Koblan L W, et al., Nat Biotechnol. 2018 October; 36(9):843-846. doi: 10.1038/nbt.4172.) as provided below. Polynucleotide sequences having at least 95% or greater identity to the ABE nucleic acid sequence are also encompassed.

(SEQ ID NO: 173)
ATATGCCAAGTACGCCCCCTATTGACGTCAATGACGGTAAATGGCCCGCCTGGCATTATGCCCAGTACAT

GACCTTATGGGACTTTCCTACTTGGCAGTACATCTACGTATTAGTCATCGCTATTACCATGGTGATGCGG

TTTTGGCAGTACATCAATGGGCGTGGATAGCGGTTTGACTCACGGGGATTTCCAAGTCTCCACCCCATTG

ACGTCAATGGGAGTTTGTTTTGGCACCAAAATCAACGGGACTTTCCAAAATGTCGTAACAACTCCGCCCC

ATTGACGCAAATGGGCGGTAGGCGTGTACGGTGGGAGGTCTATATAAGCAGAGCTGGTTTAGTGAACCGT

CAGATCCGCTAGAGATCCGCGGCCGCTAATACGACTCACTATAGGGAGAGCCGCCACCATGAAACGGACA

GCCGACGGAAGCGAGTTCGAGTCACCAAAGAAGAAGCGGAAAGTCTCTGAAGTCGAGTTTAGCCACGAGT

ATTGGATGAGGCACGCACTGACCCTGGCAAAGCGAGCATGGGATGAAAGAGAAGTCCCCGTGGGCGCCGT

GCTGGTGCACAACAATAGAGTGATCGGAGAGGGATGGAACAGGCCAATCGGCCGCCACGACCCTACCGCA

CACGCAGAGATCATGGCACTGAGGCAGGGAGGCCTGGTCATGCAGAATTACCGCCTGATCGATGCCACCC

TGTATGTGACACTGGAGCCATGCGTGATGTGCGCAGGAGCAATGATCCACAGCAGGATCGGAAGAGTGGT

GTTCGGAGCACGGGACGCCAAGACCGGCGCAGCAGGCTCCCTGATGGATGTGCTGCACCACCCCGGCATG

AACCACCGGGTGGAGATCACAGAGGGAATCCTGGCAGACGAGTGCGCCGCCCTGCTGAGCGATTTCTTTA

GAATGCGGAGACAGGAGATCAAGGCCCAGAAGAAGGCACAGAGCTCCACCGACTCTGGAGGATCTAGCGG

AGGATCCTCTGGAAGCGAGACACCAGGCACAAGCGAGTCCGCCACACCAGAGAGCTCCGGCGGCTCCTCC

GGAGGATCCTCTGAGGTGGAGTTTTCCCACGAGTACTGGATGAGACATGCCCTGACCCTGGCCAAGAGGG

CACGCGATGAGAGGGAGGTGCCTGTGGGAGCCGTGCTGGTGCTGAACAATAGAGTGATCGGCGAGGGCTG

GAACAGAGCCATCGGCCTGCACGACCCAACAGCCCATGCCGAAATTATGGCCCTGAGACAGGGCGGCCTG

GTCATGCAGAACTACAGACTGATTGACGCCACCCTGTACGTGACATTCGAGCCTTGCGTGATGTGCGCCG

GCGCCATGATCCACTCTAGGATCGGCCGCGTGGTGTTTGGCGTGAGGAACGCAAAAACCGGCGCCGCAGG

CTCCCTGATGGACGTGCTGCACTACCCCGGCATGAATCACCGCGTCGAAATTACCGAGGGAATCCTGGCA

GATGAATGTGCCGCCCTGCTGTGCTATTTCTTTCGGATGCCTAGACAGGTGTTCAATGCTCAGAAGAAGG

CCCAGAGCTCCACCGACTCCGGAGGATCTAGCGGAGGCTCCTCTGGCTCTGAGACACCTGGCACAAGCGA

GAGCGCAACACCTGAAAGCAGCGGGGGCAGCAGCGGGGGGTCAGACAAGAAGTACAGCATCGGCCTGGCC

ATCGGCACCAACTCTGTGGGCTGGGCCGTGATCACCGACGAGTACAAGGTGCCCAGCAAGAAATTCAAGG

TGCTGGGCAACACCGACCGGCACAGCATCAAGAAGAACCTGATCGGAGCCCTGCTGTTCGACAGCGGCGA

AACAGCCGAGGCCACCCGGCTGAAGAGAACCGCCAGAAGAAGATACACCAGACGGAAGAACCGGATCTGC

TATCTGCAAGAGATCTTCAGCAACGAGATGGCCAAGGTGGACGACAGCTTCTTCCACAGACTGGAAGAGT

CCTTCCTGGTGGAAGAGGATAAGAAGCACGAGCGGCACCCCATCTTCGGCAACATCGTGGACGAGGTGGC

CTACCACGAGAAGTACCCCACCATCTACCACCTGAGAAAGAAACTGGTGGACAGCACCGACAAGGCCGAC

CTGCGGCTGATCTATCTGGCCCTGGCCCACATGATCAAGTTCCGGGGCCACTTCCTGATCGAGGGCGACC

TGAACCCCGACAACAGCGACGTGGACAAGCTGTTCATCCAGCTGGTGCAGACCTACAACCAGCTGTTCGA

GGAAAACCCCATCAACGCCAGCGGCGTGGACGCCAAGGCCATCCTGTCTGCCAGACTGAGCAAGAGCAGA

CGGCTGGAAAATCTGATCGCCCAGCTGCCCGGCGAGAAGAAGAATGGCCTGTTCGGAAACCTGATTGCCC

TGAGCCTGGGCCTGACCCCCAACTTCAAGAGCAACTTCGACCTGGCCGAGGATGCCAAACTGCAGCTGAG

CAAGGACACCTACGACGACGACCTGGACAACCTGCTGGCCCAGATCGGCGACCAGTACGCCGACCTGTTT

CTGGCCGCCAAGAACCTGTCCGACGCCATCCTGCTGAGCGACATCCTGAGAGTGAACACCGAGATCACCA

AGGCCCCCCTGAGCGCCTCTATGATCAAGAGATACGACGAGCACCACCAGGACCTGACCCTGCTGAAAGC

TCTCGTGCGGCAGCAGCTGCCTGAGAAGTACAAAGAGATTTTCTTCGACCAGAGCAAGAACGGCTACGCC

GGCTACATTGACGGCGGAGCCAGCCAGGAAGAGTTCTACAAGTTCATCAAGCCCATCCTGGAAAAGATGG

-continued

ACGGCACCGAGGAACTGCTCGTGAAGCTGAACAGAGAGGACCTGCTGCGGAAGCAGCGGACCTTCGACAA

CGGCAGCATCCCCCACCAGATCCACCTGGGAGAGCTGCACGCCATTCTGCGGCGGCAGGAAGATTTTTAC

CCATTCCTGAAGGACAACCGGGAAAAGATCGAGAAGATCCTGACCTTCCGCATCCCCTACTACGTGGGCC

CTCTGGCCAGGGGAAACAGCAGATTCGCCTGGATGACCAGAAAGAGCGAGGAAACCATCACCCCCTGGAA

CTTCGAGGAAGTGGTGGACAAGGGCGCTTCCGCCCAGAGCTTCATCGAGCGGATGACCAACTTCGATAAG

AACCTGCCCAACGAGAAGGTGCTGCCCAAGCACAGCCTGCTGTACGAGTACTTCACCGTGTATAACGAGC

TGACCAAAGTGAAATACGTGACCGAGGGAATGAGAAAGCCCGCCTTCCTGAGCGGCGAGCAGAAAAAGGC

CATCGTGGACCTGCTGTTCAAGACCAACCGGAAAGTGACCGTGAAGCAGCTGAAAGAGGACTACTTCAAG

AAAATCGAGTGCTTCGACTCCGTGGAAATCTCCGGCGTGGAAGATCGGTTCAACGCCTCCCTGGGCACAT

ACCACGATCTGCTGAAAATTATCAAGGACAAGGACTTCCTGGACAATGAGGAAAACGAGGACATTCTGGA

AGATATCGTGCTGACCCTGACACTGTTTGAGGACAGAGAGATGATCGAGGAACGGCTGAAAACCTATGCC

CACCTGTTCGACGACAAAGTGATGAAGCAGCTGAAGCGGCGGAGATACACCGGCTGGGGCAGGCTGAGCC

GGAAGCTGATCAACGGCATCCGGGACAAGCAGTCCGGCAAGACAATCCTGGATTTCCTGAAGTCCGACGG

CTTCGCCAACAGAAACTTCATGCAGCTGATCCACGACGACAGCCTGACCTTTAAAGAGGACATCCAGAAA

GCCCAGGTGTCCGGCCAGGGCGATAGCCTGCACGAGCACATTGCCAATCTGGCCGGCAGCCCCGCCATTA

AGAAGGGCATCCTGCAGACAGTGAAGGTGGTGGACGAGCTCGTGAAAGTGATGGGCCGGCACAAGCCCGA

GAACATCGTGATCGAAATGGCCAGAGAGAACCAGACCACCCAGAAGGGACAGAAGAACAGCCGCGAGAGA

ATGAAGCGGATCGAAGAGGGCATCAAAGAGCTGGGCAGCCAGATCCTGAAAGAACACCCCGTGGAAAACA

CCCAGCTGCAGAACGAGAAGCTGTACCTGTACTACCTGCAGAATGGGCGGGATATGTACGTGGACCAGGA

ACTGGACATCAACCGGCTGTCCGACTACGATGTGGACCATATCGTGCCTCAGAGCTTTCTGAAGGACGAC

TCCATCGACAACAAGGTGCTGACCAGAAGCGACAAGAACCGGGGCAAGAGCGACAACGTGCCCTCCGAAG

AGGTCGTGAAGAAGATGAAGAACTACTGGCGGCAGCTGCTGAACGCCAAGCTGATTACCCAGAGAAAGTT

CGACAATCTGACCAAGGCCGAGAGAGGCGGCCTGAGCGAACTGGATAAGGCCGGCTTCATCAAGAGACAG

CTGGTGGAAACCCGGCAGATCACAAAGCACGTGGCACAGATCCTGGACTCCCGGATGAACACTAAGTACG

ACGAGAATGACAAGCTGATCCGGGAAGTGAAAGTGATCACCCTGAAGTCCAAGCTGGTGTCCGATTTCCG

GAAGGATTTCCAGTTTTACAAAGTGCGCGAGATCAACAACTACCACCACGCCCACGACGCCTACCTGAAC

GCCGTCGTGGGAACCGCCCTGATCAAAAAGTACCCTAAGCTGGAAAGCGAGTTCGTGTACGGCGACTACA

AGGTGTACGACGTGCGGAAGATGATCGCCAAGAGCGAGCAGGAAATCGGCAAGGCTACCGCCAAGTACTT

CTTCTACAGCAACATCATGAACTTTTTCAAGACCGAGATTACCCTGGCCAACGGCGAGATCCGGAAGCGG

CCTCTGATCGAGACAAACGGCGAAACCGGGGAGATCGTGTGGGATAAGGGCCGGGATTTTGCCACCGTGC

GGAAAGTGCTGAGCATGCCCCAAGTGAATATCGTGAAAAAGACCGAGGTGCAGACAGGCGGCTTCAGCAA

AGAGTCTATCCTGCCCAAGAGGAACAGCGATAAGCTGATCGCCAGAAAGAAGGACTGGGACCCTAAGAAG

TACGGCGGCTTCGACAGCCCCACCGTGGCCTATTCTGTGCTGGTGGTGGCCAAAGTGGAAAAGGGCAAGT

CCAAGAAACTGAAGAGTGTGAAAGAGCTGCTGGGGATCACCATCATGGAAAGAAGCAGCTTCGAGAAGAA

TCCCATCGACTTTCTGGAAGCCAAGGGCTACAAAGAAGTGAAAAAGGACCTGATCATCAAGCTGCCTAAG

TACTCCCTGTTCGAGCTGGAAAACGGCCGGAAGAGAATGCTGGCCTCTGCCGGCGAACTGCAGAAGGGAA

ACGAACTGGCCCTGCCCTCCAAATATGTGAACTTCCTGTACCTGGCCAGCCACTATGAGAAGCTGAAGGG

CTCCCCCGAGGATAATGAGCAGAAACAGCTGTTTGTGGAACAGCACAAGCACTACCTGGACGAGATCATC

GAGCAGATCAGCGAGTTCTCCAAGAGAGTGATCCTGGCCGACGCTAATCTGGACAAAGTGCTGTCCGCCT

ACAACAAGCACCGGGATAAGCCCATCAGAGAGCAGGCCGAGAATATCATCCACCTGTTTACCCTGACCAA

TCTGGGAGCCCCTGCCGCCTTCAAGTACTTTGACACCACCATCGACCGGAAGAGGTACACCAGCACCAAA

-continued

GAGGTGCTGGACGCCACCCTGATCCACCAGAGCATCACCGGCCTGTACGAGACACGGATCGACCTGTCTC

AGCTGGGAGGTGACTCTGGCGGCTCAAAAAGAACCGCCGACGGCAGCGAATTCGAGCCCAAGAAGAAGAG

GAAAGTCTAACCGGTCATCATCACCATCACCATTGAGTTTAAACCCGCTGATCAGCCTCGACTGTGCCTT

CTAGTTGCCAGCCATCTGTTGTTTGCCCCTCCCCCGTGCCTTCCTTGACCCTGGAAGGTGCCACTCCCAC

TGTCCTTTCCTAATAAAATGAGGAAATTGCATCGCATTGTCTGAGTAGGTGTCATTCTATTCTGGGGGGT

GGGGTGGGGCAGGACAGCAAGGGGGAGGATTGGGAAGACAATAGCAGGCATGCTGGGGATGCGGTGGGCT

CTATGGCTTCTGAGGCGGAAAGAACCAGCTGGGGCTCGATACCGTCGACCTCTAGCTAGAGCTTGGCGTA

ATCATGGTCATAGCTGTTTCCTGTGTGAAATTGTTATCCGCTCACAATTCCACACAACATACGAGCCGGA

AGCATAAAGTGTAAAGCCTAGGGTGCCTAATGAGTGAGCTAACTCACATTAATTGCGTTGCGCTCACTGC

CCGCTTTCCAGTCGGGAAACCTGTCGTGCCAGCTGCATTAATGAATCGGCCAACGCGCGGGGAGAGGCGG

TTTGCGTATTGGGCGCTCTTCCGCTTCCTCGCTCACTGACTCGCTGCGCTCGGTCGTTCGGCTGCGGCGA

GCGGTATCAGCTCACTCAAAGGCGGTAATACGGTTATCCACAGAATCAGGGGATAACGCAGGAAAGAACA

TGTGAGCAAAAGGCCAGCAAAAGGCCAGGAACCGTAAAAAGGCCGCGTTGCTGGCGTTTTTCCATAGGCT

CCGCCCCCCTGACGAGCATCACAAAAATCGACGCTCAAGTCAGAGGTGGCGAAACCCGACAGGACTATAA

AGATACCAGGCGTTTCCCCCTGGAAGCTCCCTCGTGCGCTCTCCTGTTCCGACCCTGCCGCTTACCGGAT

ACCTGTCCGCCTTTCTCCCTTCGGGAAGCGTGGCGCTTTCTCATAGCTCACGCTGTAGGTATCTCAGTTC

GGTGTAGGTCGTTCGCTCCAAGCTGGGCTGTGTGCACGAACCCCCCGTTCAGCCCGACCGCTGCGCCTTA

TCCGGTAACTATCGTCTTGAGTCCAACCCGGTAAGACACGACTTATCGCCACTGGCAGCAGCCACTGGTA

ACAGGATTAGCAGAGCGAGGTATGTAGGCGGTGCTACAGAGTTCTTGAAGTGGTGGCCTAACTACGGCTA

CACTAGAAGAACAGTATTTGGTATCTGCGCTCTGCTGAAGCCAGTTACCTTCGGAAAAAGAGTTGGTAGC

TCTTGATCCGGCAAACAAACCACCGCTGGTAGCGGTGGTTTTTTTGTTTGCAAGCAGCAGATTACGCGCA

GAAAAAAAGGATCTCAAGAAGATCCTTTGATCTTTTCTACGGGGTCTGACACTCAGTGGAACGAAAACTC

ACGTTAAGGGATTTTGGTCATGAGATTATCAAAAAGGATCTTCACCTAGATCCTTTTAAATTAAAAATGA

AGTTTTAAATCAATCTAAAGTATATATGAGTAAACTTGGTCTGACAGTTACCAATGCTTAATCAGTGAGG

CACCTATCTCAGCGATCTGTCTATTTCGTTCATCCATAGTTGCCTGACTCCCCGTCGTGTAGATAACTAC

GATACGGGAGGGCTTACCATCTGGCCCCAGTGCTGCAATGATACCGCGAGACCCACGCTCACCGGCTCCA

GATTTATCAGCAATAAACCAGCCAGCCGGAAGGGCCGAGCGCAGAAGTGGTCCTGCAACTTTATCCGCCT

CCATCCAGTCTATTAATTGTTGCCGGGAAGCTAGAGTAAGTAGTTCGCCAGTTAATAGTTTGCGCAACGT

TGTTGCCATTGCTACAGGCATCGTGGTGTCACGCTCGTCGTTTGGTATGGCTTCATTCAGCTCCGGTTCC

CAACGATCAAGGCGAGTTACATGATCCCCCATGTTGTGCAAAAAAGCGGTTAGCTCCTTCGGTCCTCCGA

TCGTTGTCAGAAGTAAGTTGGCCGCAGTGTTATCACTCATGGTTATGGCAGCACTGCATAATTCTCTTAC

TGTCATGCCATCCGTAAGATGCTTTTCTGTGACTGGTGAGTACTCAACCAAGTCATTCTGAGAATAGTGT

ATGCGGCGACCGAGTTGCTCTTGCCCGGCGTCAATACGGGATAATACCGCGCCACATAGCAGAACTTTAA

AAGTGCTCATCATTGGAAAACGTTCTTCGGGGCGAAAACTCTCAAGGATCTTACCGCTGTTGAGATCCAG

TTCGATGTAACCCACTCGTGCACCCAACTGATCTTCAGCATCTTTTACTTTCACCAGCGTTTCTGGGTGA

GCAAAAACAGGAAGGCAAAATGCCGCAAAAAAGGGAATAAGGGCGACACGGAAATGTTGAATACTCATAC

TCTTCCTTTTTCAATATTATTGAAGCATTTATCAGGGTTATTGTCTCATGAGCGGATACATATTTGAATG

TATTTAGAAAAATAAACAAATAGGGGTTCCGCGCACATTTCCCCGAAAAGTGCCACCTGACGTCGACGGA

TCGGGAGATCGATCTCCCGATCCCCTAGGGTCGACTCTCAGTACAATCTGCTCTGATGCCGCATAGTTAA

GCCAGTATCTGCTCCCTGCTTGTGTGTTGGAGGTCGCTGAGTAGTGCGCGAGCAAAATTTAAGCTACAAC

-continued

AAGGCAAGGCTTGACCGACAATTGCATGAAGAATCTGCTTAGGGTTAGGCGTTTTGCGCTGCTTCGCGAT

GTACGGGCCAGATATACGCGTTGACATTGATTATTGACTAGTTATTAATAGTAATCAATTACGGGGTCAT

TAGTTCATAGCCCATATATGGAGTTCCGCGTTACATAACTTACGGTAAATGGCCCGCCTGGCTGACCGCC

CAACGACCCCCGCCCATTGACGTCAATAATGACGTATGTTCCCATAGTAACGCCAATAGGGACTTTCCAT

TGACGTCAATGGGTGGAGTATTTACGGTAAACTGCCCACTTGGCAGTACATCAAGTGTATC

By way of example, a cytidine base editor (CBE) as used in the base editing compositions, systems and methods described herein has the following nucleic acid sequence (8877 base pairs), (Addgene, Watertown, M A.; Komor A C, et al., 2017, Sci Adv., 30; 3(8):eaao4774. doi: 10.1126/sciadv.aao4774) as provided below. Polynucleotide sequences having at least 95% or greater identity to the BE4 nucleic acid sequence are also encompassed.

(SEQ ID NO: 174)

1 ATATGCCAAG TACGCCCCCT ATTGACGTCA ATGACGGTAA ATGGCCCGCC TGGCATTATG

61 CCCAGTACAT GACCTTATGG GACTTTCCTA CTTGGCAGTA CATCTACGTA TTAGTCATCG

121 CTATTACCAT GGTGATGCGG TTTTGGCAGT ACATCAATGG GCGTGGATAG CGGTTTGACT

181 CACGGGGATT TCCAAGTCTC CACCCCATTG ACGTCAATGG GAGTTTGTTT TGGCACCAAA

241 ATCAACGGGA CTTTCCAAAA TGTCGTAACA ACTCCGCCCC ATTGACGCAA ATGGGCGGTA

301 GGCGTGTACG GTGGGAGGTC TATATAAGCA GAGCTGGTTT AGTGAACCGT CAGATCCGCT

361 AGAGATCCGC GGCCGCTAAT ACGACTCACT ATAGGGAGAG CCGCCACCAT GAGCTCAGAG

421 ACTGGCCCAG TGGCTGTGGA CCCCACATTG AGACGGCGGA TCGAGCCCCA TGAGTTTGAG

481 GTATTCTTCG ATCCGAGAGA GCTCCGCAAG GAGACCTGCC TGCTTTACGA AATTAATTGG

541 GGGGGCCGGC ACTCCATTTG GCGACATACA TCACAGAACA CTAACAAGCA CGTCGAAGTC

601 AACTTCATCG AGAAGTTCAC GACAGAAAGA TATTTCTGTC CGAACACAAG GTGCAGCATT

661 ACCTGGTTTC TCAGCTGGAG CCCATGCGGC GAATGTAGTA GGGCCATCAC TGAATTCCTG

721 TCAAGGTATC CCCACGTCAC TCTGTTTATT TACATCGCAA GGCTGTACCA CCACGCTGAC

781 CCCCGCAATC GACAAGGCCT GCGGGATTTG ATCTCTTCAG GTGTGACTAT CCAAATTATG

841 ACTGAGCAGG AGTCAGGATA CTGCTGGAGA AACTTTGTGA ATTATAGCCC GAGTAATGAA

901 GCCCACTGGC CTAGGTATCC CCATCTGTGG GTACGACTGT ACGTTCTTGA ACTGTACTGC

961 ATCATACTGG GCCTGCCTCC TTGTCTCAAC ATTCTGAGAA GGAAGCAGCC ACAGCTGACA

1021 TTCTTTACCA TCGCTCTTCA GTCTTGTCAT TACCAGCGAC TGCCCCCACA CATTCTCTGG

1081 GCCACCGGGT TGAAATCTGG TGGTTCTTCT GGTGGTTCTA GCGGCAGCGA GACTCCCGGG

1141 ACCTCAGAGT CCGCCACACC CGAAAGTTCT GGTGGTTCTT CTGGTGGTTC TGATAAAAAG

1201 TATTCTATTG GTTTAGCCAT CGGCACTAAT TCCGTTGGAT GGGCTGTCAT AACCGATGAA

1261 TACAAAGTAC CTTCAAAGAA ATTTAAGGTG TTGGGGAACA CAGACCGTCA TTCGATTAAA

1321 AAGAATCTTA TCGGTGCCCT CCTATTCGAT AGTGGCGAAA CGGCAGAGGC GACTCGCCTG

1381 AAACGAACCG CTCGGAGAAG GTATACACGT CGCAAGAACC GAATATGTTA CTTACAAGAA

1441 ATTTTTAGCA ATGAGATGGC CAAAGTTGAC GATTCTTTCT TTCACCGTTT GGAAGAGTCC

1501 TTCCTTGTCG AAGAGGACAA GAAACATGAA CGGCACCCCA TCTTTGGAAA CATAGTAGAT

1561 GAGGTGGCAT ATCATGAAAA GTACCCAACG ATTTATCACC TCAGAAAAAA GCTAGTTGAC

1621 TCAACTGATA AAGCGGACCT GAGGTTAATC TACTTGGCTC TTGCCCATAT GATAAAGTTC

1681 CGTGGGCACT TTCTCATTGA GGGTGATCTA AATCCGGACA ACTCGGATGT CGACAAACTG

1741 TTCATCCAGT TAGTACAAAC CTATAATCAG TTGTTTGAAG AGAACCCTAT AAATGCAAGT

1801 GGCGTGGATG CGAAGGCTAT TCTTAGCGCC CGCCTCTCTA AATCCCGACG GCTAGAAAAC

-continued

1861 CTGATCGCAC AATTACCCGG AGAGAAGAAA AATGGGTTGT TCGGTAACCT TATAGCGCTC

1921 TCACTAGGCC TGACACCAAA TTTTAAGTCG AACTTCGACT TAGCTGAAGA TGCCAAATTG

1981 CAGCTTAGTA AGGACACGTA CGATGACGAT CTCGACAATC TACTGGCACA AATTGGAGAT

2041 CAGTATGCGG ACTTATTTTT GGCTGCCAAA AACCTTAGCG ATGCAATCCT CCTATCTGAC

2101 ATACTGAGAG TTAATACTGA GATTACCAAG GCGCCGTTAT CCGCTTCAAT GATCAAAAGG

2161 TACGATGAAC ATCACCAAGA CTTGACACTT CTCAAGGCCC TAGTCCGTCA GCAACTGCCT

2221 GAGAAATATA AGGAAATATT CTTTGATCAG TCGAAAAACG GGTACGCAGG TTATATTGAC

2281 GGCGGAGCGA GTCAAGAGGA ATTCTACAAG TTTATCAAAC CCATATTAGA GAAGATGGAT

2341 GGGACGGAAG AGTTGCTTGT AAAACTCAAT CGCGAAGATC TACTGCGAAA GCAGCGGACT

2401 TTCGACAACG GTAGCATTCC ACATCAAATC CACTTAGGCG AATTGCATGC TATACTTAGA

2461 AGGCAGGAGG ATTTTTATCC GTTCCTCAAA GACAATCGTG AAAAGATTGA GAAAATCCTA

2521 ACCTTTCGCA TACCTTACTA TGTGGGACCC CTGGCCCGAG GGAACTCTCG GTTCGCATGG

2581 ATGACAAGAA AGTCCGAAGA AACGATTACT CCATGGAATT TTGAGGAAGT TGTCGATAAA

2641 GGTGCGTCAG CTCAATCGTT CATCGAGAGG ATGACCAACT TTGACAAGAA TTTACCGAAC

2701 GAAAAAGTAT TGCCTAAGCA CAGTTTACTT TACGAGTATT TCACAGTGTA CAATGAACTC

2761 ACGAAAGTTA AGTATGTCAC TGAGGGCATG CGTAAACCCG CCTTTCTAAG CGGAGAACAG

2821 AAGAAAGCAA TAGTAGATCT GTTATTCAAG ACCAACCGCA AAGTGACAGT TAAGCAATTG

2881 AAAGAGGACT ACTTTAAGAA AATTGAATGC TTCGATTCTG TCGAGATCTC CGGGGTAGAA

2941 GATCGATTTA ATGCGTCACT TGGTACGTAT CATGACCTCC TAAAGATAAT TAAAGATAAG

3001 GACTTCCTGG ATAACGAAGA GAATGAAGAT ATCTTAGAAG ATATAGTGTT GACTCTTACC

3061 CTCTTTGAAG ATCGGGAAAT GATTGAGGAA AGACTAAAAA CATACGCTCA CCTGTTCGAC

3121 GATAAGGTTA TGAAACAGTT AAAGAGGCGT CGCTATACGG GCTGGGGACG ATTGTCGCGG

3181 AAACTTATCA ACGGGATAAG AGACAAGCAA AGTGGTAAAA CTATTCTCGA TTTTCTAAAG

3241 AGCGACGGCT TCGCCAATAG GAACTTTATG CAGCTGATCC ATGATGACTC TTTAACCTTC

3301 AAAGAGGATA TACAAAAGGC ACAGGTTTCC GGACAAGGGG ACTCATTGCA CGAACATATT

3361 GCGAATCTTG CTGGTTCGCC AGCCATCAAA AAGGGCATAC TCCAGACAGT CAAAGTAGTG

3421 GATGAGCTAG TTAAGGTCAT GGGACGTCAC AAACCGGAAA ACATTGTAAT CGAGATGGCA

3481 CGCGAAAATC AAACGACTCA GAAGGGGCAA AAAAACAGTC GAGAGCGGAT GAAGAGAATA

3541 GAAGAGGGTA TTAAAGAACT GGGCAGCCAG ATCTTAAAGG AGCATCCTGT GGAAAATACC

3601 CAATTGCAGA ACGAGAAACT TTACCTCTAT TACCTACAAA ATGGAAGGGA CATGTATGTT

3661 GATCAGGAAC TGGACATAAA CCGTTTATCT GATTACGACG TCGATCACAT TGTACCCCAA

3721 TCCTTTTTGA AGGACGATTC AATCGACAAT AAAGTGCTTA CACGCTCGGA TAAGAACCGA

3781 GGGAAAAGTG ACAATGTTCC AAGCGAGGAA GTCGTAAAGA AAATGAAGAA CTATTGGCGG

3841 CAGCTCCTAA ATGCGAAACT GATAACGCAA AGAAAGTTCG ATAACTTAAC TAAAGCTGAG

3901 AGGGGTGGCT TGTCTGAACT TGACAAGGCC GGATTTATTA AACGTCAGCT CGTGGAAACC

3961 CGCCAAATCA CAAAGCATGT TGCACAGATA CTAGATTCCC GAATGAATAC GAAATACGAC

4021 GAGAACGATA AGCTGATTCG GGAAGTCAAA GTAATCACTT TAAAGTCAAA ATTGGTGTCG

4081 GACTTCAGAA AGGATTTTCA ATTCTATAAA GTTAGGGAGA TAAATAACTA CCACCATGCG

4141 CACGACGCTT ATCTTAATGC CGTCGTAGGG ACCGCACTCA TTAAGAAATA CCCGAAGCTA

4201 GAAAGTGAGT TTGTGTATGG TGATTACAAA GTTTATGACG TCCGTAAGAT GATCGCGAAA

4261 AGCGAACAGG AGATAGGCAA GGCTACAGCC AAATACTTCT TTTATTCTAA CATTATGAAT

-continued

4321 TTCTTTAAGA CGGAAATCAC TCTGGCAAAC GGAGAGATAC GCAAACGACC TTTAATTGAA

4381 ACCAATGGGG AGACAGGTGA AATCGTATGG GATAAGGGCC GGGACTTCGC GACGGTGAGA

4441 AAAGTTTTGT CCATGCCCCA AGTCAACATA GTAAAGAAAA CTGAGGTGCA GACCGGAGGG

4501 TTTTCAAAGG AATCGATTCT TCCAAAAAGG AATAGTGATA AGCTCATCGC TCGTAAAAAG

4561 GACTGGGACC CGAAAAAGTA CGGTGGCTTC GATAGCCCTA CAGTTGCCTA TTCTGTCCTA

4621 GTAGTGGCAA AAGTTGAGAA GGGAAAATCC AAGAAACTGA AGTCAGTCAA AGAATTATTG

4681 GGGATAACGA TTATGGAGCG CTCGTCTTTT GAAAAGAACC CCATCGACTT CCTTGAGGCG

4741 AAAGGTTACA AGGAAGTAAA AAAGGATCTC ATAATTAAAC TACCAAAGTA TAGTCTGTTT

4801 GAGTTAGAAA ATGGCCGAAA ACGGATGTTG GCTAGCGCCG GAGAGCTTCA AAAGGGGAAC

4861 GAACTCGCAC TACCGTCTAA ATACGTGAAT TTCCTGTATT TAGCGTCCCA TTACGAGAAG

4921 TTGAAAGGTT CACCTGAAGA TAACGAACAG AAGCAACTTT TTGTTGAGCA GCACAAACAT

4981 TATCTCGACG AAATCATAGA GCAAATTTCG GAATTCAGTA AGAGAGTCAT CCTAGCTGAT

5041 GCCAATCTGG ACAAAGTATT AAGCGCATAC AACAAGCACA GGGATAAACC CATACGTGAG

5101 CAGGCGGAAA ATATTATCCA TTTGTTTACT CTTACCAACC TCGGCGCTCC AGCCGCATTC

5161 AAGTATTTTG ACACAACGAT AGATCGCAAA CGATACACTT CTACCAAGGA GGTGCTAGAC

5221 GCGACACTGA TTCACCAATC CATCACGGGA TTATATGAAA CTCGGATAGA TTTGTCACAG

5281 CTTGGGGGTG ACTCTGGTGG TTCTGGAGGA TCTGGTGGTT CTACTAATCT GTCAGATATT

5341 ATTGAAAAGG AGACCGGTAA GCAACTGGTT ATCCAGGAAT CCATCCTCAT GCTCCCAGAG

5401 GAGGTGGAAG AAGTCATTGG GAACAAGCCG GAAAGCGATA TACTCGTGCA CACCGCCTAC

5461 GACGAGAGCA CCGACGAGAA TGTCATGCTT CTGACTAGCG ACGCCCCTGA ATACAAGCCT

5521 TGGGCTCTGG TCATACAGGA TAGCAACGGT GAGAACAAGA TTAAGATGCT CTCTGGTGGT

5581 TCTGGAGGAT CTGGTGGTTC TACTAATCTG TCAGATATTA TTGAAAAGGA GACCGGTAAG

5641 CAACTGGTTA TCCAGGAATC CATCCTCATG CTCCCAGAGG AGGTGGAAGA AGTCATTGGG

5701 AACAAGCCGG AAAGCGATAT ACTCGTGCAC ACCGCCTACG ACGAGAGCAC CGACGAGAAT

5761 GTCATGCTTC TGACTAGCGA CGCCCCTGAA TACAAGCCTT GGGCTCTGGT CATACAGGAT

5821 AGCAACGGTG AGAACAAGAT TAAGATGCTC TCTGGTGGTT CTCCCAAGAA GAAGAGGAAA

5881 GTCTAACCGG TCATCATCAC CATCACCATT GAGTTTAAAC CCGCTGATCA GCCTCGACTG

5941 TGCCTTCTAG TTGCCAGCCA TCTGTTGTTT GCCCCTCCCC CGTGCCTTCC TTGACCCTGG

6001 AAGGTGCCAC TCCCACTGTC CTTTCCTAAT AAAATGAGGA AATTGCATCG CATTGTCTGA

6061 GTAGGTGTCA TTCTATTCTG GGGGGTGGGG TGGGGCAGGA CAGCAAGGGG GAGGATTGGG

6121 AAGACAATAG CAGGCATGCT GGGGATGCGG TGGGCTCTAT GGCTTCTGAG GCGGAAAGAA

6181 CCAGCTGGGG CTCGATACCG TCGACCTCTA GCTAGAGCTT GGCGTAATCA TGGTCATAGC

6241 TGTTTCCTGT GTGAAATTGT TATCCGCTCA CAATTCCACA CAACATACGA GCCGGAAGCA

6301 TAAAGTGTAA AGCCTAGGGT GCCTAATGAG TGAGCTAACT CACATTAATT GCGTTGCGCT

6361 CACTGCCCGC TTTCCAGTCG GGAAACCTGT CGTGCCAGCT GCATTAATGA ATCGGCCAAC

6421 GCGCGGGGAG AGGCGGTTTG CGTATTGGGC GCTCTTCCGC TTCCTCGCTC ACTGACTCGC

6481 TGCGCTCGGT CGTTCGGCTG CGGCGAGCGG TATCAGCTCA CTCAAAGGCG GTAATACGGT

6541 TATCCACAGA ATCAGGGGAT AACGCAGGAA AGAACATGTG AGCAAAAGGC CAGCAAAAGG

6601 CCAGGAACCG TAAAAAGGCC GCGTTGCTGG CGTTTTTCCA TAGGCTCCGC CCCCCTGACG

6661 AGCATCACAA AAATCGACGC TCAAGTCAGA GGTGGCGAAA CCCGACAGGA CTATAAAGAT

-continued

6721 ACCAGGCGTT TCCCCCTGGA AGCTCCCTCG TGCGCTCTCC TGTTCCGACC CTGCCGCTTA

6781 CCGGATACCT GTCCGCCTTT CTCCCTTCGG GAAGCGTGGC GCTTTCTCAT AGCTCACGCT

6841 GTAGGTATCT CAGTTCGGTG TAGGTCGTTC GCTCCAAGCT GGGCTGTGTG CACGAACCCC

6901 CCGTTCAGCC CGACCGCTGC GCCTTATCCG GTAACTATCG TCTTGAGTCC AACCCGGTAA

6961 GACACGACTT ATCGCCACTG GCAGCAGCCA CTGGTAACAG GATTAGCAGA GCGAGGTATG

7021 TAGGCGGTGC TACAGAGTTC TTGAAGTGGT GGCCTAACTA CGGCTACACT AGAAGAACAG

7081 TATTTGGTAT CTGCGCTCTG CTGAAGCCAG TTACCTTCGG AAAAAGAGTT GGTAGCTCTT

7141 GATCCGGCAA ACAAACCACC GCTGGTAGCG GTGGTTTTTT TGTTTGCAAG CAGCAGATTA

7201 CGCGCAGAAA AAAAGGATCT CAAGAAGATC CTTTGATCTT TTCTACGGGG TCTGACGCTC

7261 AGTGGAACGA AAACTCACGT TAAGGGATTT TGGTCATGAG ATTATCAAAA AGGATCTTCA

7321 CCTAGATCCT TTTAAATTAA AAATGAAGTT TTAAATCAAT CTAAAGTATA TATGAGTAAA

7381 CTTGGTCTGA CAGTTACCAA TGCTTAATCA GTGAGGCACC TATCTCAGCG ATCTGTCTAT

7441 TTCGTTCATC CATAGTTGCC TGACTCCCCG TCGTGTAGAT AACTACGATA CGGGAGGGCT

7501 TACCATCTGG CCCCAGTGCT GCAATGATAC CGCGAGACCC ACGCTCACCG GCTCCAGATT

7561 TATCAGCAAT AAACCAGCCA GCCGGAAGGG CCGAGCGCAG AAGTGGTCCT GCAACTTTAT

7621 CCGCCTCCAT CCAGTCTATT AATTGTTGCC GGGAAGCTAG AGTAAGTAGT TCGCCAGTTA

7681 ATAGTTTGCG CAACGTTGTT GCCATTGCTA CAGGCATCGT GGTGTCACGC TCGTCGTTTG

7741 GTATGGCTTC ATTCAGCTCC GGTTCCCAAC GATCAAGGCG AGTTACATGA TCCCCCATGT

7801 TGTGCAAAAA AGCGGTTAGC TCCTTCGGTC CTCCGATCGT TGTCAGAAGT AAGTTGGCCG

7861 CAGTGTTATC ACTCATGGTT ATGGCAGCAC TGCATAATTC TCTTACTGTC ATGCCATCCG

7921 TAAGATGCTT TTCTGTGACT GGTGAGTACT CAACCAAGTC ATTCTGAGAA TAGTGTATGC

7981 GGCGACCGAG TTGCTCTTGC CCGGCGTCAA TACGGGATAA TACCGCGCCA CATAGCAGAA

8041 CTTTAAAAGT GCTCATCATT GGAAAACGTT CTTCGGGGCG AAAACTCTCA AGGATCTTAC

8101 CGCTGTTGAG ATCCAGTTCG ATGTAACCCA CTCGTGCACC CAACTGATCT TCAGCATCTT

8161 TTACTTTCAC CAGCGTTTCT GGGTGAGCAA AAACAGGAAG GCAAAATGCC GCAAAAAAGG

8221 GAATAAGGGC GACACGGAAA TGTTGAATAC TCATACTCTT CCTTTTTCAA TATTATTGAA

8281 GCATTTATCA GGGTTATTGT CTCATGAGCG GATACATATT TGAATGTATT TAGAAAAATA

8341 AACAAATAGG GGTTCCGCGC ACATTTCCCC GAAAAGTGCC ACCTGACGTC GACGGATCGG

8401 GAGATCGATC TCCCGATCCC CTAGGGTCGA CTCTCAGTAC AATCTGCTCT GATGCCGCAT

8461 AGTTAAGCCA GTATCTGCTC CCTGCTTGTG TGTTGGAGGT CGCTGAGTAG TGCGCGAGCA

8521 AAATTTAAGC TACAACAAGG CAAGGCTTGA CCGACAATTG CATGAAGAAT CTGCTTAGGG

8581 TTAGGCGTTT TGCGCTGCTT CGCGATGTAC GGGCCAGATA TACGCGTTGA CATTGATTAT

8641 TGACTAGTTA TTAATAGTAA TCAATTACGG GGTCATTAGT TCATAGCCCA TATATGGAGT

8701 TCCGCGTTAC ATAACTTACG GTAAATGGCC CGCCTGGCTG ACCGCCCAAC GACCCCCGCC

-continued

8761 CATTGACGTC AATAATGACG TATGTTCCCA TAGTAACGCC AATAGGGACT TTCCATTGAC

8821 GTCAATGGGT GGAGTATTTA CGGTAAACTG CCCACTTGGC AGTACATCAA GTGTATC

In some embodiments, the cytidine base editor is BE4 having a nucleic acid sequence selected from one of the following:

Original BE4 Nucleic Acid Sequence:

(SEQ ID NO: 175)

ATGagctcagagactggcccagtggctgtggaccccacattgagacggcggatcgagccccatgagtt tgaggtattcttcgatccgagagagctccgcaaggagacctgcctgctttacgaaattaattgggggg gccggcactccatttggcgacatacatcacagaacactaacaagcacgtcgaagtcaacttcatcgag aagttcacgacagaaagatatttctgtccgaacacaaggtgcagcattacctggtttctcagctggag ccgcgaatgtagtagggccatcactgaattcctgtcaaggtatccccacgtcactctgtttatttaca tcgcaaggctgtaccaccacgctgacccccgcaatcgacaaggcctgcgggatttgatctcttcaggt gtgactatccaaattatgactgagcaggagtcaggatactgctggagaaactttgtgaattatagccc gagtaatgaagcccactggcctaggtatccccatctgtgggtacgactgtacgttcttgaactgtact gcatcatactgggcctgcctccttgtctcaacattctgagaaggaagcagccacagctgacattcttt accatcgctcttcagtcttgtcattaccagcgactgcccccacacattctctgggccaccgggttgaa atctggtggttcttctggtggttctagcggcagcgagactcccgggacctcagagtccgccacacccg aaagttctggtggttcttctggtggttctgataaaaagtattctattggtttagccatcggcactaat tccgttggatgggctgtcataaccgatgaatacaaagtaccttcaaagaaatttaaggtgttggggaa cacagaccgtcattcgattaaaaagaatcttatcggtgccctcctattcgatagtggcgaaacggcag aggcgactcgcctgaaacgaaccgctcggagaaggtatacacgtcgcaagaaccgaatatgttactta caagaaatttttagcaatgagatggccaaagttgacgattctttctttcaccgtttggaagagtcctt ccttgtcgaagaggacaagaaacatgaacggcaccccatctttggaaacatagtagatgaggtggcat atcatgaaaagtacccaacgatttatcacctcagaaaaaagctagttgactcaactgataaagcggac ctgaggttaatctacttggctcttgcccatatgataaagttccgtgggcactttctcattgagggtga tctaaatccggacaactcggatgtcgacaaactgttcatccagttagtacaaacctataatcagttgt ttgaagagaaccctataaatgcaagtggcgtggatgcgaaggctattcttagcgcccgcctctctaaa tcccgacggctagaaaacctgatcgcacaattacccggagagaagaaaaatgggttgttcggtaacct tatagcgctctcactaggcctgacaccaaattttaagtcgaacttcgacttagctgaagatgccaaat tgcagcttagtaaggacacgtacgatgacgatctcgacaatctactggcacaaattggagatcagtat gcggacttatttttggctgccaaaaaccttagcgatgcaatcctcctatctgacatactgagagttaa tactgagattaccaaggcgccgttatccgcttcaatgatcaaaaggtacgatgaacatcaccaagact tgacacttctcaaggccctagtccgtcagcaactgcctgagaaatataaggaaatattctttgatcag tcgaaaaacgggtacgcaggttatattgacggcggagcgagtcaagaggaattctacaagtttatcaa acccatattagagaagatggatgggacggaagagttgcttgtaaaactcaatcgcgaagatctactgc gaaagcagcggactttcgacaacggtagcattccacatcaaatccacttaggcgaattgcatgctata cttagaaggcaggaggatttttatccgttcctcaaagacaatcgtgaaaagattgagaaaatcctaac ctttcgcataccttactatgtgggacccctggcccgagggaactctcggttcgcatggatgacaagaa agtccgaagaaacgattactccatggaattttgaggaagttgtcgataaaggtgcgtcagctcaatcg ttcatcgagaggatgaccaactttgacaagaatttaccgaacgaaaaagtattgcctaagcacagttt -continued actttacgagtatttcacagtgtacaatgaactcacgaaagttaagtatgtcactgagggcatgcgta aacccgcctttctaagcggagaacagaagaaagcaatagtagatctgttattcaagaccaaccgcaaa gtgacagttaagcaattgaaagaggactactttaagaaaattgaatgcttcgattctgtcgagatctc cggggtagaagatcgatttaatgcgtcacttggtacgtatcatgacctcctaaagataattaaagata aggacttcctggataacgaagagaatgaagatatcttagaagatatagtgttgactcttaccctcttt gaagatcgggaaatgattgaggaaagactaaaaacatacgctcacctgttcgacgataaggttatgaa acagttaaagaggcgtcgctatacgggctggggacgattgtcgcggaaacttatcaacgggataagag acaagcaaagtggtaaaactattctcgattttctaaagagcgacggcttcgccaataggaactttatg cagctgatccatgatgactctttaaccttcaaagaggatatacaaaaggcacaggtttccggacaagg ggactcattgcacgaacatattgcgaatcttgctggttcgccagccatcaaaaagggcatactccaga cagtcaaagtagtggatgagctagttaaggtcatgggacgtcacaaaccggaaaacattgtaatcgag atggcacgcgaaaatcaaacgactcagaaggggcaaaaaaacagtcgagagcggatgaagagaataga agagggtattaaagaactgggcagccagatcttaaaggagcatcctgtggaaaatacccaattgcaga acgagaaactttacctctattacctacaaaatggaagggacatgtatgttgatcaggaactggacata aaccgtttatctgattacgacgtcgatcacattgtaccccaatcctttttgaaggacgattcaatcga caataaagtgcttacacgctcggataagaaccgagggaaaagtgacaatgttccaagcgaggaagtcg taaagaaaatgaagaactattggcggcagctcctaaatgcgaaactgataacgcaaagaaagttcgat aacttaactaaagctgagaggggtggcttgtctgaacttgacaaggccggatttattaaacgtcagct cgtggaaacccgccaaatcacaaagcatgttgcacagatactagattcccgaatgaatacgaaatacg acgagaacgataagctgattcgggaagtcaaagtaatcactttaaagtcaaaattggtgtcggacttc agaaaggattttcaattctataaagttagggagataaataactaccaccatgcgcacgacgcttatct taatgccgtcgtagggaccgcactcattaagaaatacccgaagctagaaagtgagtttgtgtatggtg attacaaagtttatgacgtccgtaagatgatcgcgaaaagcgaacaggagataggcaaggctacagcc aaatacttcttttattctaacattatgaatttctttaagacggaaatcactctggcaaacggagagat acgcaaacgacctttaattgaaaccaatggggagacaggtgaaatcgtatgggataagggccgggact tcgcgacggtgagaaaagttttgtccatgccccaagtcaacatagtaaagaaaactgaggtgcagacc ggagggttttcaaaggaatcgattcttccaaaaaggaatagtgataagctcatcgctcgtaaaaagga ctgggacccgaaaaagtacggtggcttcgatagccctacagttgcctattctgtcctagtagtggcaa aagttgagaagggaaaatccaagaaactgaagtcagtcaaagaattattggggataacgattatggag cgctcgtcttttgaaaagaaccccatcgacttccttgaggcgaaaggttacaaggaagtaaaaaagga tctcataattaaactaccaaagtatagtctgtttgagttagaaaatggccgaaaacggatgttggcta gcgccggagagcttcaaaaggggaacgaactcgcactaccgtctaaatacgtgaatttcctgtattta gcgtcccattacgagaagttgaaaggttcacctgaagataacgaacagaagcaactttttgttgagca gcacaaacattatctcgacgaaatcatagagcaaatttcggaattcagtaagagagtcatcctagctg atgccaatctggacaaagtattaagcgcatacaacaagcacagggataaacccatacgtgagcaggcg gaaaatattatccatttgtttactcttaccaacctcggcgctccagccgcattcaagtattttgacac aacgatagatcgcaaacgatacacttctaccaaggaggtgctagacgcgacactgattcaccaatcca tcacgggattatatgaaactcggatagatttgtcacagcttgggggtgactctggtggttctggagga tctggtggttctactaatctgtcagatattattgaaaaggagaccggtaagcaactggttatccagga atccatcctcatgctcccagaggaggtggaagaagtcattgggaacaagccggaaagcgatatactcg tgcacaccgcctacgacgagagcaccgacgagaatgtcatgcttctgactagcgacgcccctgaatac -continued aagccttgggctctggtcatacaggatagcaacggtgagaacaagattaagatgctctctggtggttc
tggaggatctggtggttctactaatctgtcagatattattgaaaaggagaccggtaagcaactggtta
tccaggaatccatcctcatgctcccagaggaggtggaagaagtcattgggaacaagccggaaagcgat
atactcgtgcacaccgcctacgacgagagcaccgacgagaatgtcatgcttctgactagcgacgcccc
tgaatacaagccttgggctctggtcatacaggatagcaacggtgagaacaagattaagatgctctctg
gtggttctAAAAGGACGGCGGACGGATCAGAGTTCGAGAGTCCGAAAAAAAAACGAAAGGTCGAAtaa BE4 Codon Optimization 1 Nucleic Acid Sequence:

(SEQ ID NO: 176)

ATGTCATCCGAAACCGGGCCAGTGGCCGTAGACCCAACACTCAGGAGGCGGATAGAACCCCATGAGTT
TGAAGTGTTCTTCGACCCCAGAGAGCTGCGCAAAGAGACTTGCCTCCTGTATGAAATAAATTGGGGGG
GTCGCCATTCAATTTGGAGGCACACTAGCCAGAATACTAACAAACACGTGGAGGTAAATTTTATCGAG
AAGTTTACCACCGAAAGATACTTTTGCCCCAATACACGGTGTTCAATTACCTGGTTTCTGTCATGGAG
TCCATGTGGAGAATGTAGTAGAGCGATAACTGAGTTCCTGTCTCGATATCCTCACGTCACGTTGTTTA
TATACATCGCTCGGCTTTATCACCATGCGGACCCGCGGAACAGGCAAGGTCTTCGGGACCTCATATCC
TCTGGGGTGACCATCCAGATAATGACGGAGCAAGAGAGCGGATACTGCTGGCGAAACTTTGTTAACTA
CAGCCCAAGCAATGAGGCACACTGGCCTAGATATCCGCATCTCTGGGTTCGACTGTATGTCCTTGAAC
TGTACTGCATAATTCTGGGACTTCCGCCATGCTTGAACATTCTGCGGCGGAAACAACCACAGCTGACC
TTTTTCACGATTGCTCTCCAAAGTTGTCACTACCAGCGATTGCCACCCCACATCTTGTGGGCTACTGG
ACTCAAGTCTGGAGGAAGTTCAGGCGGAAGCAGCGGGTCTGAAACGCCCGGAACCTCAGAGAGCGCAA
CGCCCGAAAGCTCTGGAGGGTCAAGTGGTGGTAGTGATAAGAAATACTCCATCGGCCTCGCCATCGGT
ACGAATTCTGTCGGTTGGGCCGTTATCACCGATGAGTACAAGGTCCCTTCTAAGAAATTCAAGGTTTT
GGGCATACAGACCGCCATTCTATAAAAAAAAAACCTGATCGGCGCCCTTTTGTTTGACAGTGGTGAGA
CTGCTGAAGCGACTCGCCTGAAGCGAACTGCCAGGAGGCGGTATACGAGGCGAAAAAACCGAATTTGT
TACCTCCAGGAGATTTTCTCAAATGAAATGGCCAAGGTAGATGATAGTTTTTTTCACCGCTTGGAAGA
AAGTTTTCTCGTTGAGGAGGACAAAAAGCACGAGAGGCACCCAATCTTTGGCAACATAGTCGATGAGG
TCGCATACCATGAGAAATATCCTACGATCTATCATCTCCGCAAGAAGCTGGTCGATAGCACGGATAAA
GCTGACCTCCGGCTGATCTACCTTGCTCTTGCTCACATGATTAAATTCAGGGGCCATTTCCTGATAGA
AGGAGACCTCAATCCCGACAATTCTGATGTCGACAAACTGTTTATTCAGCTCGTTCAGACCTATAATC
AACTCTTTGAGGAGAACCCCATCAATGCTTCAGGGGTGGACGCAAAGGCCATTTTGTCCGCGCGCTTG
AGTAAATCACGACGCCTCGAGAATTTGATAGCTCAACTGCCGGGTGAGAAGAAAAACGGGTTGTTTGG
GAATCTCATAGCGTTGAGTTTGGGACTTACGCCAAACTTTAAGTCTAACTTTGATTTGGCCGAAGATG
CCAAATTGCAGCTGTCCAAAGATACCTATGATGACGACTTGGATAACCTTCTTGCGCAGATTGGTGAC
CAATACGCGGATCTGTTTCTTGCCGCAAAAAATCTGTCCGACGCCATACTCTTGTCCGATATACTGCG
CGTCAATACTGAGATAACTAAGGCTCCCCTCAGCGCGTCCATGATTAAAAGATACGATGAGCACCACC
AAGATCTCACTCTGTTGAAAGCCCTGGTTCGCCAGCAGCTTCCAGAGAAGTATAAGGAGATATTTTTC
GACCAATCTAAAAACGGCTATGCGGGTTACATTGACGGTGGCGCCTCTCAAGAAGAATTCTACAAGTT
TATAAAGCCGATACTTGAGAAAATGGACGGTACAGAGGAATTGTTGGTTAAGCTCAATCGCGAGGACT
TGTTGAGAAAGCAGCGCACATTTGACAATGGTAGTATTCCACACCAGATTCATCTGGGCGAGTTGCAT
GCCATTCTTAGAAGACAAGAAGATTTTTATCCGTTTCTGAAAGATAACAGAGAAAAGATTGAAAAGAT
ACTTACCTTTCGCATACCGTATTATGTAGGTCCCCTGGCTAGAGGGAACAGTCGCTTCGCTTGGATGA

-continued

CTCGAAAATCAGAAGAAACAATAACCCCCTGGAATTTTGAAGAAGTGGTAGATAAAGGTGCGAGTGCC

CAATCTTTTATTGAGCGGATGACAAATTTTGACAAGAATCTGCCTAACGAAAAGGTGCTTCCCAAGCA

TTCCCTTTTGTATGAATACTTTACAGTATATAATGAACTGACTAAAGTGAAGTACGTTACCGAGGGGA

TGCGAAAGCCAGCTTTTCTCAGTGGCGAGCAGAAAAAAGCAATAGTTGACCTGCTGTTCAAGACGAAT

AGGAAGGTTACCGTCAAACAGCTCAAAGAAGATTACTTTAAAAAGATCGAATGTTTTGATTCAGTTGA

GATAAGCGGAGTAGAGGATAGATTTAACGCAAGTCTTGGAACTTATCATGACCTTTTGAAGATCATCA

AGGATAAAGATTTTTTGGACAACGAGGAGAATGAAGATATCCTGGAAGATATAGTACTTACCTTGACG

CTTTTTGAAGATCGAGAGATGATCGAGGAGCGACTTAAGACGTACGCACATCTCTTTGACGATAAGGT

TATGAAACAATTGAAACGCCGGCGGTATACTGGCTGGGGCAGGCTTTCTCGAAAGCTGATTAATGGTA

TCCGCGATAAGCAGTCTGGAAAGACAATCCTTGACTTTCTGAAAAGTGATGGATTTGCAAATAGAAAC

TTTATGCAGCTTATACATGATGACTCTTTGACGTTCAAGGAAGACATCCAGAAGGCACAGGTATCCGG

CCAAGGGGATAGCCTCCATGAACACATAGCCAACCTGGCCGGCTCACCAGCTATTAAAAAGGGAATAT

TGCAAACCGTTAAGGTTGTTGACGAACTCGTTAAGGTTATGGGCCGACACAAACCAGAGAATATCGTG

ATTGAGATGGCTAGGGAGAATCAGACCACTCAAAAAGGTCAGAAAAATTCTCGCGAAAGGATGAAGCG

AATTGAAGAGGGAATCAAAGAACTTGGCTCTCAAATTTTGAAAGAGCACCCGGTAGAAAACACTCAGC

TGCAGAATGAAAAGCTGTATCTGTATTATCTGCAGAATGGTCGAGATATGTACGTTGATCAGGAGCTG

GATATCAATAGGCTCAGTGACTACGATGTCGACCACATCGTTCCTCAATCTTTCCTGAAAGATGACTC

TATCGACAACAAAGTGTTGACGCGATCAGATAAGAACCGGGGAAAATCCGACAATGTACCCTCAGAAG

AAGTTGTCAAGAAGATGAAAAACTATTGGAGACAATTGCTGAACGCCAAGCTCATAACACAACGCAAG

TTCGATAACTTGACGAAAGCCGAAAGAGGTGGGTTGTCAGAATTGGACAAAGCTGGCTTTATTAAGCG

CCAATTGGTGGAGACCCGGCAGATTACGAAACACGTAGCACAAATTTTGGATTCACGAATGAATACCA

AATACGACGAAAACGACAAATTGATACGCGAGGTGAAAGTGATTACGCTTAAGAGTAAGTTGGTTTCC

GATTTCAGGAAGGATTTTCAGTTTTACAAAGTAAGAGAAATAAACAACTACCACCACGCCCATGATGC

TTACCTCAACGCGGTAGTTGGCACAGCTCTTATCAAAAAATATCCAAAGCTGGAAAGCGAGTTCGTTT

ACGGTGACTATAAAGTATACGACGTTCGGAAGATGATAGCCAAATCAGAGCAGGAAATTGGGAAGGCA

ACCGCAAAATACTTCTTCTATTCAAACATCATGAACTTCTTTAAGACGGAGATTACGCTCGCGAACGG

CGAAATACGCAAGAGGCCCCTCATAGAGACTAACGGCGAAACCGGGGAGATCGTATGGGACAAAGGAC

GGGACTTTGCGACCGTTAGAAAAGTACTTTCAATGCCACAAGTGAATATTGTTAAAAAGACAGAAGTA

CAAACAGGGGGGTTCAGTAAGGAATCCATTTTGCCCAAGCGGAACAGTGATAAATTGATAGCAAGGAA

AAAAGATTGGGACCCTAAGAAGTACGGTGGTTTCGACTCTCCTACCGTTGCATATTCAGTCCTTGTAG

TTGCGAAAGTGGAAAAGGGGAAAAGTAAGAAGCTTAAGAGTGTTAAAGAGCTTCTGGGCATAACCATA

ATGGAACGGTCTAGCTTCGAGAAAAATCCAATTGACTTTCTCGAGGCTAAAGGTTACAAGGAGGTAAA

AAAGGACCTGATAATTAAACTCCCAAAGTACAGTCTCTTCGAGTTGGAGAATGGGAGGAAGAGAATGT

TGGCATCTGCAGGGGAGCTCCAAAAGGGGAACGAGCTGGCTCTGCCTTCAAAATACGTGAACTTTCTG

TACCTGGCCAGCCACTACGAGAAACTCAAGGGTTCTCCTGAGGATAACGAGCAGAAACAGCTGTTTGT

AGAGCAGCACAAGCATTACCIGGACGAGATAATTGAGCAAATTAGTGAGTICTCAAAAAGAGTAATCC

TTGCAGACGCGAATCTGGATAAAGTTCTTTCCGCCTATAATAAGCACCGGGACAAGCCTATACGAGAA

CAAGCCGAGAACATCATTCACCTCTTTACCCTTACTAATCTGGGCGCGCCGGCCGCCTTCAAATACTT

CGACACCACGATAGACAGGAAAAGGTATACGAGTACCAAAGAAGTACTTGACGCCACTCTCATCCACC

AGTCTATAACAGGGTTGTACGAAACGAGGATAGATTTGTCCCAGCTCGGCGGCGACTCAGGAGGGTCA

-continued

GGCGGCTCCGGTGGATCAACGAATCTTTCCGACATAATCGAGAAAGAAACCGGCAAACAGTTGGTGAT

CCAAGAATCAATCCTGATGCTGCCTGAAGAAGTAGAAGAGGTGATTGGCAACAAACCTGAGTCTGACA

TTCTTGTCCACACCGCGTATGACGAGAGCACGGACGAGAACGTTATGCTTCTCACTAGCGACGCCCCT

GAGTATAAACCATGGGCGCTGGTCATCCAAGATTCCAATGGGGAAAACAAGATTAAGATGCTTAGTGG

TGGGTCTGGAGGGAGCGGTGGGTCCACGAACCTCAGCGACATTATTGAAAAAGAGACTGGTAAACAAC

TTGTAATACAAGAGTCTATTCTGATGTTGCCTGAAGAGGTGGAGGAGGTGATTGGGAACAAACCGGAG

TCTGATATACTTGTTCATACCGCCTATGACGAATCTACTGATGAGAATGTGATGCTTTTAACGTCAGA

CGCTCCCGAGTACAAACCCTGGGCTCTGGTGATTCAGGACAGCAATGGTGAGAATAAGATTAAAATGT

TGAGTGGGGGCTCAAAGCGCACGGCTGACGGTAGCGAATTTGAGAGCCCCCGAAAGGTC

GAAtaa

BE4 Codon Optimization 2 Nucleic Acid Sequence:

(SEQ ID NO: 177)

ATGAGCAGCGAGACAGGCCCTGTGGCTGTGGATCCTACACTGCGGAGAAGAATCGAGCCCCA

CGAGTTCGAGGTGTTCTTCGACCCCAGAGAGCTGCGGAAAGAGACATGCCTGCTGTACGAGATCAACT

GGGGCGGCAGACACTCTATCTGGCGGCACACAAGCCAGAACACCAACAAGCACGTGGAAGTGAACTTT

ATCGAGAAGTTTACGACCGAGCGGTACTTCTGCCCCAACACCAGATGCAGCATCACCTGGTTTCTGAG

CTGGTCCCCTTGCGGCGAGTGCAGCAGAGCCATCACCGAGTTTCTGTCCAGATATCCCCACGTGACCC

TGTTCATCTATATCGCCCGGCTGTACCACCACGCCGATCCTAGAAATAGACAGGGACTGCGCGACCTG

ATCAGCAGCGGAGTGACCATCCAGATCATGACCGAGCAAGAGAGCGGCTACTGCTGGCGGAACTTCGT

GAACTACAGCCCCAGCAACGAAGCCCACTGGCCTAGATATCCTCACCTGTGGGTCCGACTGTACGTGC

TGGAACTGTACTGCATCATCCTGGGCCTGCCTCCATGCCTGAACATCCTGAGAAGAAAGCAGCCTCAG

CTGACCTTCTTCACAATCGCCCTGCAGAGCTGCCACTACCAGAGACTGCCTCCACACATCCTGTGGGC

CACCGGACTTAAGAGCGGAGGATCTAGCGGCGGCTCTAGCGGATCTGAGACACCTGGCACAAGCGAGT

CTGCCACACCTGAGAGTAGCGGCGGATCTTCTGGCGGCTCCGACAAGAAGTACTCTATCGGACTGGCC

ATCGGCACCAACTCTGTTGGATGGGCCGTGATCACCGACGAGTACAAGGTGCCCAGCAAGAAATTCAA

GGTGCTGGGCAACACCGACCGGCACAGCATCAAGAAGAATCTGATCGGCGCCCTGCTGTTCGACTCTG

GCGAAACAGCCGAAGCCACCAGACTGAAGAGAACCGCCAGGCGGAGATACACCCGGCGGAAGAACCGG

ATCTGCTACCTGCAAGAGATCTTCAGCAACGAGATGGCCAAGGTGGACGACAGCTTCTTCCACAGACT

GGAAGAGTCCTTCCTGGTGGAAGAGGACAAGAAGCACGAGCGGCACCCCATCTTCGGCAACATCGTGG

ATGAGGTGGCCTACCACGAGAAGTACCCCACCATCTACCACCTGAGAAAGAAACTGGTGGACAGCACC

GACAAGGCCGACCTGAGACTGATCTACCTGGCTCTGGCCCACATGATCAAGTTCCGGGGCCACTTTCT

GATCGAGGGCGATCTGAACCCCGACAACAGCGACGTGGACAAGCTGTTCATCCAGCTGGTGCAGACCT

ACAACCAGCTGTTCGAGGAAAACCCCATCAACGCCTCTGGCGTGGACGCCAAGGCTATCCTGTCTGCC

AGACTGAGCAAGAGCAGAAGGCTGGAAAACCTGATCGCCCAGCTGCCTGGCGAGAAGAAGAATGGCCT

GTTCGGCAACCTGATTGCCCTGAGCCTGGGACTGACCCCTAACTTCAAGAGCAACTTCGACCTGGCCG

AGGATGCCAAACTGCAGCTGAGCAAGGACACCTACGACGACGACCTGGACAATCTGCTGGCCCAGATC

GGCGATCAGTACGCCGACTTGTTTCTGGCCGCCAAGAACCTGTCCGACGCCATCCTGCTGAGCGATAT

CCTGAGAGTGAACACCGAGATCACAAAGGCCCCTCTGAGCGCCTCTATGATCAAGAGATACGACGAGC

ACCACCAGGATCTGACCCTGCTGAAGGCCCTCGTTAGACAGCAGCTGCCAGAGAAGTACAAAGAGATT

TTCTTCGATCAGTCCAAGAACGGCTACGCCGGCTACATTGATGGCGGAGCCAGCCAAGAGGAATTCTA

-continued

CAAGTTCATCAAGCCCATCCTGGAAAAGATGGACGGCACCGAGGAACTGCTGGTCAAGCTGAACAGAG

AGGACCTGCTGCGGAAGCAGCGGACCTTCGACAATGGCTCTATCCCTCACCAGATCCACCTGGGAGAG

CTGCACGCCATTCTGCGGAGACAAGAGGACTTTTACCCATTCCTGAAGGACAACCGGGAAAAGATCGA

GAAGATCCTGACCTTCAGGATCCCCTACTACGTGGGACCACTGGCCAGAGGCAATAGCAGATTCGCCT

GGATGACCAGAAAGAGCGAGGAAACCATCACACCCTGGAACTTCGAGGAAGTGGTGGACAAGGGCGCC

AGCGCTCAGTCCTTCATCGAGCGGATGACCAACTTCGATAAGAACCTGCCTAACGAGAAGGTGCTGCC

CAAGCACTCCCTGCTGTATGAGTACTTCACCGTGTACAACGAGCTGACCAAAGTGAAATACGTGACCG

AGGGAATGAGAAAGCCCGCCTTTCTGAGCGGCGAGCAGAAAAAGGCCATTGTGGATCTGCTGTTCAAG

ACCAACCGGAAAGTGACCGTGAAGCAGCTGAAAGAGGACTACTTCAAGAAAATCGAGTGCTTCGACAG

CGTGGAAATCAGCGGCGTGGAAGATCGGTTCAATGCCAGCCTGGGCACATACCACGACCTGCTGAAAA

TTATCAAGGACAAGGACTTCCTGGACAACGAAGAGAACGAGGACATTCTCGAGGACATCGTGCTGACC

CTGACACTGTTTGAGGACAGAGAGATGATCGAGGAACGGCTGAAAACATACGCCCACCTGTTCGACGA

CAAAGTGATGAAGCAACTGAAGCGGAGGCGGTACACAGGCTGGGGCAGACTGTCTCGGAAGCTGATCA

ACGGCATCCGGGATAAGCAGTCCGGCAAGACAATCCTGGATTTCCTGAAGTCCGACGGCTTCGCCAAC

AGAAACTTCATGCAGCTGATCCACGACGACAGCCTGACCTTTAAAGAGGACATCCAGAAAGCCCAGGT

GTCCGGCCAAGGCGATTCTCTGCACGAGCACATTGCCAACCTGGCCGGATCTCCCGCCATTAAGAAGG

GCATCCTGCAGACAGTGAAGGTGGTGGACGAGCTTGTGAAAGTGATGGGCAGACACAAGCCCGAGAAC

ATCGTGATCGAAATGGCCAGAGAGAACCAGACCACACAGAAGGGCCAGAAGAACAGCCGCGAGAGAAT

GAAGCGGATCGAAGAGGGCATCAAAGAGCTGGGCAGCCAGATCCTGAAAGAACACCCCGTGGAAAACA

CCCAGCTGCAGAACGAGAAGCTGTACCTGTACTACCTGCAGAATGGACGGGATATGTACGTGGACCAA

GAGCTGGACATCAACCGGCTGAGCGACTACGATGTGGACCATATCGTGCCCCAGAGCTTTCTGAAGGA

CGACTCCATCGATAACAAGGTCCTGACCAGAAGCGACAAGAACCGGGGCAAGAGCGATAACGTGCCCT

CCGAAGAGGTGGTCAAGAAGATGAAGAACTACTGGCGACAGCTGCTGAACGCCAAGCTGATTACCCAG

CGGAAGTTCGATAACCTGACCAAGGCCGAGAGAGGCGGCCTGAGCGAACTTGATAAGGCCGGCTTCAT

TAAGCGGCAGCTGGTGGAAACCCGGCAGATCACCAAACACGTGGCACAGATTCTGGACTCCCGGATGA

ACACTAAGTACGACGAGAATGACAAGCTGATCCGGGAAGTGAAAGTCATCACCCTGAAGTCTAAGCTG

GTGTCCGATTTCCGGAAGGATTTCCAGTTCTACAAAGTGCGGGAAATCAACAACTACCATCACGCCCA

CGACGCCTACCTGAATGCCGTTGTTGGAACAGCCCTGATCAAGAAGTATCCCAAGCTGGAAAGCGAGT

TCGTGTACGGCGACTACAAGGTGTACGACGTGCGGAAGATGATCGCCAAGAGCGAACAAGAGATCGGC

AAGGCTACCGCCAAGTACTTTTTCTACAGCAACATCATGAACTTTTTCAAGACAGAGATCACCCTGGC

CAACGGCGAGATCCGGAAAAGACCCCTGATCGAGACAAACGGCGAAACCGGGGAGATCGTGTGGGATA

AGGGCAGAGATTTTGCCACAGTGCGGAAAGTGCTGAGCATGCCCCAAGTGAATATCGTGAAGAAAACC

GAGGTGCAGACAGGCGGCTTCAGCAAAGAGTCTATCCTGCCTAAGCGGAACAGCGATAAGCTGATCGC

CAGAAAGAAGGACTGGGACCCTAAGAAGTACGGCGGCTTCGATAGCCCTACCGTGGCCTATTCTGTGC

TGGTGGTGGCCAAAGTGGAAAAGGGCAAGTCCAAAAAGCTCAAGAGCGTGAAAGAGCTGCTGGGGATC

ACCATCATGGAAAGAAGCAGCTTTGAGAAGAACCCGATCGACTTTCTGGAAGCCAAGGGCTACAAAGA

AGTCAAGAAGGACCTCATCATCAAGCTCCCCAAGTACAGCCTGTTCGAGCTGGAAAATGGCCGGAAGC

GGATGCTGGCCTCAGCAGGCGAACTGCAGAAAGGCAATGAACTGGCCCTGCCTAGCAAATACGTCAAC

TTCCTGTACCTGGCCAGCCACTATGAGAAGCTGAAGGGCAGCCCCGAGGACAATGAGCAAAAGCAGCT

GTTTGTGGAACAGCACAAGCACTACCTGGACGAGATCATCGAGCAGATCAGCGAGTTCTCCAAGAGAG

TGATCCTGGCCGACGCTAACCTGGATAAGGTGCTGTCTGCCTATAACAAGCACCGGGACAAGCCTATC

-continued

```
AGAGAGCAGGCCGAGAATATCATCCACCTGTTTACCCTGACCAACCTGGGAGCCCCTGCCGCCTTCAA

GTACTTCGACACCACCATCGACCGGAAGAGGTACACCAGCACCAAAGAGGTGCTGGACGCCACACTGA

TCCACCAGTCTATCACCGGCCTGTACGAAACCCGGATCGACCTGTCTCAGCTCGGCGGCGATTCTGGT

GGTTCTGGCGGAAGTGGCGGATCCACCAATCTGAGCGACATCATCGAAAAAGAGACAGGCAAGCAGCT

CGTGATCCAAGAATCCATCCTGATGCTGCCTGAAGAGGTTGAGGAAGTGATCGGCAACAAGCCTGAGT

CCGACATCCTGGTGCACACCGCCTACGATGAGAGCACCGATGAGAACGTCATGCTGCTGACAAGCGAC

GCCCCTGAGTACAAGCCTTGGGCTCTCGTGATTCAGGACAGCAATGGGGAGAACAAGATCAAGATGCT

GAGCGGAGGTAGCGGAGGCAGTGGCGGAAGCACAAACCTGTCTGATATCATTGAAAAAGAAACCGGGA

AGCAACTGGTCATTCAAGAGTCCATTCTCATGCTCCCGGAAGAAGTCGAGGAAGTCATTGGAAACAAA

CCCGAGAGCGATATTCTGGTCCACACAGCCTATGACGAGTCTACAGACGAAAACGTGATGCTCCTGAC

CTCTGACGCTCCCGAGTATAAGCCCTGGGCACTTGTTATCCAGGACTCTAACGGGGAAAACAAAATCA

AAATGTTGTCCGGCGGCAGCAAGCGGACAGCCGATGGATCTGAGTTCGAGAGCCCCAAGAAGAAACGG

AAGGTgGAGtaa
```

By "base editing activity" is meant acting to chemically alter a base within a polynucleotide. In one embodiment, a first base is converted to a second base. In one embodiment, the base editing activity is cytidine deaminase activity, e.g., converting target C·G to T·A. In another embodiment, the base editing activity is adenosine or adenine deaminase activity, e.g., converting A·T to G·C. In another embodiment, the base editing activity is cytidine deaminase activity, e.g., converting target C·G to T·A, and adenosine or adenine deaminase activity, e.g., converting A·T to G·C.

The term "base editor system" refers to a system for editing a nucleobase of a target nucleotide sequence. In various embodiments, the base editor system comprises (1) a polynucleotide programmable nucleotide binding domain (e.g. Cas9); (2) one or more deaminase domains (e.g. an adenosine deaminase and/or a cytidine deaminase) for deaminating said nucleobase; and (3) one or more guide polynucleotide (e.g., guide RNA). In some embodiments, the base editor (BE) system comprises (1) a polynucleotide programmable nucleotide binding domain (e.g. Cas9), an adenosine deaminase domain and a cytidine deaminase domain for deaminating nucleobases in the target nucleotide sequence; and (2) one or more guide polynucleotides (e.g., guide RNA) in conjunction with the polynucleotide programmable nucleotide binding domain. In some embodiments, the polynucleotide programmable nucleotide binding domain is a polynucleotide programmable DNA binding domain. In some embodiments, the base editor is a cytidine base editor (CBE). In some embodiments, the base editor system is BE4. In some embodiments, the base editor is an adenine or adenosine base editor (ABEIn some embodiments, the base editor is an adenine or adenosine base editor (ABE) and a cytidine base editor (CBE). In some embodiments, the base editor is an abasic editor.

In some embodiments, a base editor system may comprise more than one base editing component. For example, a base editor system may include one or more deaminases (e.g., adenosine deaminase, cytidine deaminase). In some embodiments, a single guide polynucleotide may be utilized to target different deaminases to a target nucleic acid sequence. In some embodiments, a single pair of guide polynucleotides may be utilized to target different deaminases to a target nucleic acid sequence.

The deaminase domain and the polynucleotide programmable nucleotide binding component of a base editor system may be associated with each other covalently or non-covalently, or any combination of associations and interactions thereof. For example, in some embodiments, one or more deaminase domains can be targeted to a target nucleotide sequence by a polynucleotide programmable nucleotide binding domain. In some embodiments, a polynucleotide programmable nucleotide binding domain can be fused or linked to one or more deaminase domains. In some embodiments, a polynucleotide programmable nucleotide binding domain can target one or more deaminase domains to a target nucleotide sequence by non-covalently interacting with or associating with the deaminase domain. For example, in some embodiments, the deaminase domain can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, one or more deaminase domains can be targeted to a target nucleotide sequence by a guide polynucleotide. For example, in some embodiments, the deaminase domain can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a BER inhibitor. In some embodiments, the inhibitor of BER can be a uracil DNA glycosylase inhibitor (UGI). In some embodiments, the inhibitor of BER can be an inosine BER inhibitor. In some embodiments, the inhibitor of BER can be targeted to the target nucleotide sequence by the polynucleotide programmable nucleotide binding domain. In some embodiments, a polynucleotide programmable nucleotide binding domain can be fused or linked to an inhibitor of BER. In some embodiments, a polynucleotide programmable nucleotide binding domain can be fused or linked to one or more deaminase domains and an inhibitor of BER. In some embodiments, a polynucleotide programmable nucleotide binding domain can target an inhibitor of BER to a target nucleotide sequence by non-covalently interacting with or associating with the inhibitor of BER. For example, in some embodiments, the inhibitor of BER component can comprise an additional heterologous portion or domain that is capable of interacting with, associating with, or capable of forming a complex with an additional heterologous portion or domain that is part of a polynucleotide programmable nucleotide binding domain.

In some embodiments, the inhibitor of BER can be targeted to the target nucleotide sequence by the guide polynucleotide. For example, in some embodiments, the inhibitor of BER can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of BER. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

The term "Cas9" or "Cas9 domain" refers to an RNA guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a Casnl nuclease or a CRISPR (clustered regularly interspaced short palindromic repeat) associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA," or simply "gNRA") can be engineered so as to incorporate aspects of both the crRNA and tracrRNA into a single RNA species. See, e.g., Jinek M., et al., *Science* 337:816-821 (2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., Proc. Natl. Acad. Sci. U.S.A. 98:4658-4663(2001); "CRISPR RNA maturation by trans-encoded small RNA and host factor RNase III." Deltcheva E., et al., Nature 471:602-607(2011); and "A programmable dual-RNA-guided DNA endonuclease in adaptive bacterial immunity." Jinek M., et al., *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

An exemplary Cas9, is *Streptococcus pyogenes* Cas9 (spCas9), the amino acid sequence of which is provided below:

(SEQ ID NO: 178)

```
MDKKYSIGLDIGTNSVGWAVITDDYKVPSKKFKVLGNTDRHSIKKNLIGALLFGSGETAEAT
RLKRTARRRYTRRKNRICYLQEIFSNEMAKVDDSFFHRLEESFLVEEDKKHERHPIFGNIVD
EVAYHEKYPTIYHLRKKLADSTDKADLRLIYLALAHMIKFRGHFLIEGDLNPDNSDVDKLFI
QLVQIYNQLFEENPINASRVDAKAILSARLSKSRRLENLIAQLPGEKRNGLFGNLIALSLGL
TPNFKSNFDLAEDAKLQLSKDTYDDDLDNLLAQIGDQYADLFLAAKNLSDAILLSDILRVNS
EITKAPLSASMIKRYDEHHQDLTLLKALVRQQLPEKYKEIFFDQSKNGYAGYIDGGASQEEF
YKFIKPILEKMDGTEELLVKLNREDLLRKQRTFDNGSIPHQIHLGELHAILRRQEDFYPFLK
DNREKIEKILTFRIPYYVGPLARGNSRFAWMTRKSEETITPWNFEEVVDKGASAQSFIERMT
NFDKNLPNEKVLPKHSLLYEYFTVYNELTKVKYVTEGMRKPAFLSGEQKKAIVDLLFKTNRK
VTVKQLKEDYFKKIECFDSVEISGVEDRFNASLGAYHDLLKIIKDKDFLDNEENEDILEDIV
LTLTLFEDRGMIEERLKTYAHLFDDKVMKQLKRRRYTGWGRLSRKLINGIRDKQSGKTILDF
LKSDGFANRNFMQLIHDDSLTFKEDIQKAQVSGQGHSLHEQIANLAGSPAIKKGILQTVKIV
DELVKVMGHKPENIVIEMARENQTTQKGQKNSRERMKRIEEGIKELGSQILKEHPVENTQLQ
NEKLYLYYLQNGRDMYVDQELDINRLSDYDVDHIVPQSFIKDDSIDNKVLTRSDKNRGKSDN
VPSEEVVKKMKNYWRQLLNAKLITQRKFDNLTKAERGGLSELDKAGFIKRQLVETRQITKHV
AQILDSRMNTKYDENDKLIREVKVITLKSKLVSDFRKDFQFYKVREINNYHHAHDAYLNAVV
GTALIKKYPKLESEFVYGDYKVYDVRKMIAKSEQEIGKATAKYFFYSNIMNFFKTEITLANG
EIRKRPLIETNGETGEIVWDKGRDFATVRKVLSMPQVNIVKKTEVQTGGFSKESILPKRNSD
KLIARKKDWDPKKYGGFDSPTVAYSVLVVAKVEKGKSKKLKSVKELLGITIMERSSFEKNPI
DFLEAKGYKEVKKDLIIKLPKYSLFELENGRKRMLASAGELQKGNELALPSKYVNFLYLASH
YEKLKGSPEDNEQKQLFVEQHKHYLDEIIEQISEFSKRVILADANLDKVLSAYNKHRDKPIR
EQAENIIHLFTLTNLGAPAAFKYFDTTIDRKRYTSTKEVLDATLIHQSITGLYETRIDLSQL
GGD
```

(Single Underline: HNH Domain; Double Underline: RuvC Domain)

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science*. 337:816-821 (2012); Qi et al., "Repurposing CRISPR as an RNA-Guided Platform for Sequence-Specific Control of Gene Expression" (2013) *Cell*. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., Science. 337:816-821(2012); Qi et al., Cell. 28; 152(5):1173-83 (2013)). In some embodiments, a Cas9 nuclease has an inactive (e.g., an inactivated) DNA cleavage domain, that is, the Cas9 is a nickase, referred to as an "nCas9" protein (for "nickase" Cas9). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, wild-type Cas9 corresponds to Cas9 from *Streptococcus pyogenes* (NCBI Reference Sequence: NC_017053.1, nucleotide and amino acid sequences as follows).

```
                                                   (SEQ ID NO: 179)
ATGGATAAGAAATACTCAATAGGCTTAGATATCGGCACAAATAGCGTCGGATGGGCGGTGAT

CACTGATGATTATAAGGTTCCGTCTAAAAAGTTCAAGGTTCTGGGAAATACAGACCGCCACA

GTATCAAAAAAAATCTTATAGGGGCTCTTTTATTTGGCAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGCAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAATCTACAATCAATTATTTGAAGAAAACCCTATTAACGCAAGTAGAGTAGA

TGCTAAAGCGATTCTTTCTGCACGATTGAGTAAATCAAGACGATTAGAAAATCTCATTGCTC

AGCTCCCCGGTGAGAAGAGAAATGGCTTGTTTGGGAATCTCATTGCTTTGTCATTGGGATTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATAGT

GAAATAACTAAGGCTCCCCTATCAGCTTCAATGATTAAGCGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAGGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGCGCCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGGGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC
```

-continued

ATTTAAAGAAGATATTCAAAAAGCACAGGTGTCTGGACAAGGCCATAGTTTACATGAACAGA

TTGCTAACTTAGCTGGCAGTCCTGCTATTAAAAAAGGTATTTTACAGACTGTAAAAATTGTT

GATGAACTGGTCAAAGTAATGGGGCATAAGCCAGAAAATATCGTTATTGAAATGGCACGTGA

AAATCAGACAACTCAAAAGGGCCAGAAAAATTCGCGAGAGCGTATGAAACGAATCGAAGAAG

GTATCAAAGAATTAGGAAGTCAGATTCTTAAAGAGCATCCTGTTGAAAATACTCAATTGCAA

AATGAAAAGCTCTATCTCTATTATCTACAAAATGGAAGAGACATGTATGTGGACCAAGAATT

AGATATTAATCGTTTAAGTGATTATGATGTCGATCACATTGTTCCACAAAGTTTCATTAAAG

ACGATTCAATAGACAATAAGGTACTAACGCGTTCTGATAAAAATCGTGGTAAATCGGATAAC

GTTCCAAGTGAAGAAGTAGTCAAAAAGATGAAAAACTATTGGAGACAACTTCTAAACGCCAA

GTTAATCACTCAACGTAAGTTTGATAATTTAACGAAAGCTGAACGTGGAGGTTTGAGTGAAC

TTGATAAAGCTGGTTTTATCAAACGCCAATTGGTTGAAACTCGCCAAATCACTAAGCATGTG

GCACAAATTTTGGATAGTCGCATGAATACTAAATACGATGAAAATGATAAACTTATTCGAGA

GGTTAAAGTGATTACCTTAAAATCTAAATTAGTTTCTGACTTCCGAAAAGATTTCCAATTCT

ATAAAGTACGTGAGATTAACAATTACCATCATGCCCATGATGCGTATCTAAATGCCGTCGTT

GGAACTGCTTTGATTAAGAAATATCCAAAACTTGAATCGGAGTTTGTCTATGGTGATTATAA

AGTTTATGATGTTCGTAAAATGATTGCTAAGTCTGAGCAAGAAATAGGCAAAGCAACCGCAA

AATATTTCTTTTACTCTAATATCATGAACTTCTTCAAAACAGAAATTACACTTGCAAATGGA

GAGATTCGCAAACGCCCTCTAATCGAAACTAATGGGGAAACTGGAGAAATTGTCTGGGATAA

AGGGCGAGATTTTGCCACAGTGCGCAAAGTATTGTCCATGCCCCAAGTCAATATTGTCAAGA

AAACAGAAGTACAGACAGGCGGATTCTCCAAGGAGTCAATTTTACCAAAAAGAAATTCGGAC

AAGCTTATTGCTCGTAAAAAAGACTGGGATCCAAAAAAATATGGTGGTTTTGATAGTCCAAC

GGTAGCTTATTCAGTCCTAGTGGTTGCTAAGGTGGAAAAAGGGAAATCGAAGAAGTTAAAAT

CCGTTAAAGAGTTACTAGGGATCACAATTATGGAAAGAAGTTCCTTTGAAAAAAATCCGATT

GACTTTTTAGAAGCTAAAGGATATAAGGAAGTTAAAAAAGACTTAATCATTAAACTACCTAA

ATATAGTCTTTTTGAGTTAGAAAACGGTCGTAAACGGATGCTGGCTAGTGCCGGAGAATTAC

AAAAAGGAAATGAGCTGGCTCTGCCAAGCAAATATGTGAATTTTTTATATTTAGCTAGTCAT

TATGAAAAGTTGAAGGGTAGTCCAGAAGATAACGAACAAAAACAATTGTTTGTGGAGCAGCA

TAAGCATTATTTAGATGAGATTATTGAGCAAATCAGTGAATTTTCTAAGCGTGTTATTTTAG

CAGATGCCAATTTAGATAAAGTTCTTAGTGCATATAACAAACATAGAGACAAACCAATACGT

GAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATG

CCACTCTTATCCATCAATCCATCACTGGTCTTTATGAAACACGCATTGATTTGAGTCAGCTA

GGAGGTGACTGA (SEQ ID NO: 178)

MDKKYSIGLDIGTNSVGWAVITDDYKVPSKKFKVLGNTDRHSIKKNLIGALLFGSGETAEAT

RLKRTARRRYTRRKNRICYLQEIFSNEMAKVDDSFFHRLEESFLVEEDKKHERHPIFGNIVD

EVAYHEKYPTIYHLRKKLADSTDKADLRLIYLALAHMIKFRGHFLIEGDLNPDNSDVDKLFI

QLVQIYNQLFEENPINASRVDAKAILSARLSKSRRLENLIAQLPGEKRNGLFGNLIALSLGL

TPNFKSNFDLAEDAKLQLSKDTYDDDLDNLLAQIGDQYADLFLAAKNLSDAILLSDILRVNS

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

-continued

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGAYHDLLKIIKDKDFLDNEENEDILEDIV

LTLTLFEDRGMIEERLKTYAHLFDDKVMKQLKRRRYTGWGRLSRKLINGIRDKQSGKTILDF

LKSDGFANRNFMQLIHDDSLTFKEDIQKAQVSGQGHSLHEQIANLAGSPAIKKGILQTVKIV

DELVKVMGHKPENIVIEMARENQTTQKGQKNSRERMKRIEEGIKELGSQILKEHPVENTQLQ

NEKLYLYYLQNGRDMYVDQELDINRLSDYDVDHIVPQSFIKDDSIDNKVLTRSDKNRGKSDN

VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD (single underline: HNH domain; double underline: RuvC domain)

In some embodiments, wild-type Cas9 corresponds to, or comprises the following nucleotide and/or amino acid sequences:

(SEQ ID NO: 180)

ATGGATAAAAAGTATTCTATTGGTTTAGACATCGGCACTAATTCCGTTGGATGGGCTGTCAT

AACCGATGAATACAAAGTACCTTCAAAGAAATTTAAGGTGTTGGGGAACACAGACCGTCATT

CGATTAAAAAGAATCTTATCGGTGCCCTCCTATTCGATAGTGGCGAAACGGCAGAGGCGACT

CGCCTGAAACGAACCGCTCGGAGAAGGTATACACGTCGCAAGAACCGAATATGTTACTTACA

AGAAATTTTTAGCAATGAGATGGCCAAAGTTGACGATTCTTTCTTTCACCGTTTGGAAGAGT

CCTTCCTTGTCGAAGAGGACAAGAAACATGAACGGCACCCCATCTTTGGAAACATAGTAGAT

GAGGTGGCATATCATGAAAAGTACCCAACGATTTATCACCTCAGAAAAAAGCTAGTTGACTC

AACTGATAAAGCGGACCTGAGGTTAATCTACTTGGCTCTTGCCCATATGATAAAGTTCCGTG

GGCACTTTCTCATTGAGGGTGATCTAAATCCGGACAACTCGGATGTCGACAAACTGTTCATC

CAGTTAGTACAAACCTATAATCAGTTGTTTGAAGAGAACCCTATAAATGCAAGTGGCGTGGA

TGCGAAGGCTATTCTTAGCGCCCGCCTCTCTAAATCCCGACGGCTAGAAAACCTGATCGCAC

AATTACCCGGAGAGAAGAAAAATGGGTTGTTCGGTAACCTTATAGCGCTCTCACTAGGCCTG

ACACCAAATTTTAAGTCGAACTTCGACTTAGCTGAAGATGCCAAATTGCAGCTTAGTAAGGA

CACGTACGATGACGATCTCGACAATCTACTGGCACAAATTGGAGATCAGTATGCGGACTTAT

TTTTGGCTGCCAAAAACCTTAGCGATGCAATCCTCCTATCTGACATACTGAGAGTTAATACT

GAGATTACCAAGGCGCCGTTATCCGCTTCAATGATCAAAAGGTACGATGAACATCACCAAGA

CTTGACACTTCTCAAGGCCCTAGTCCGTCAGCAACTGCCTGAGAAATATAAGGAAATATTCT

TTGATCAGTCGAAAAACGGGTACGCAGGTTATATTGACGGCGGAGCGAGTCAAGAGGAATTC

TACAAGTTTATCAAACCCATATTAGAGAAGATGGATGGGACGGAAGAGTTGCTTGTAAAACT

-continued

CAATCGCGAAGATCTACTGCGAAAGCAGCGGACTTTCGACAACGGTAGCATTCCACATCAAA

TCCACTTAGGCGAATTGCATGCTATACTTAGAAGGCAGGAGGATTTTTATCCGTTCCTCAAA

GACAATCGTGAAAAGATTGAGAAAATCCTAACCTTTCGCATACCTTACTATGTGGGACCCCT

GGCCCGAGGGAACTCTCGGTTCGCATGGATGACAAGAAAGTCCGAAGAAACGATTACTCCAT

GGAATTTTGAGGAAGTTGTCGATAAAGGTGCGTCAGCTCAATCGTTCATCGAGAGGATGACC

AACTTTGACAAGAATTTACCGAACGAAAAAGTATTGCCTAAGCACAGTTTACTTTACGAGTA

TTTCACAGTGTACAATGAACTCACGAAAGTTAAGTATGTCACTGAGGGCATGCGTAAACCCG

CCTTTCTAAGCGGAGAACAGAAGAAAGCAATAGTAGATCTGTTATTCAAGACCAACCGCAAA

GTGACAGTTAAGCAATTGAAAGAGGACTACTTTAAGAAAATTGAATGCTTCGATTCTGTCGA

GATCTCCGGGGTAGAAGATCGATTTAATGCGTCACTTGGTACGTATCATGACCTCCTAAAGA

TAATTAAAGATAAGGACTTCCTGGATAACGAAGAGAATGAAGATATCTTAGAAGATATAGTG

TTGACTCTTACCCTCTTTGAAGATCGGGAAATGATTGAGGAAAGACTAAAAACATACGCTCA

CCTGTTCGACGATAAGGTTATGAAACAGTTAAAGAGGCGTCGCTATACGGGCTGGGGACGAT

TGTCGCGGAAACTTATCAACGGGATAAGAGACAAGCAAAGTGGTAAAACTATTCTCGATTTT

CTAAAGAGCGACGGCTTCGCCAATAGGAACTTTATGCAGCTGATCCATGATGACTCTTTAAC

CTTCAAAGAGGATATACAAAAGGCACAGGTTTCCGGACAAGGGGACTCATTGCACGAACATA

TTGCGAATCTTGCTGGTTCGCCAGCCATCAAAAAGGGCATACTCCAGACAGTCAAAGTAGTG

GATGAGCTAGTTAAGGTCATGGGACGTCACAAACCGGAAAACATTGTAATCGAGATGGCACG

CGAAAATCAAACGACTCAGAAGGGGCAAAAAAACAGTCGAGAGCGGATGAAGAGAATAGAAG

AGGGTATTAAAGAACTGGGCAGCCAGATCTTAAAGGAGCATCCTGTGGAAAATACCCAATTG

CAGAACGAGAAACTTTACCTCTATTACCTACAAAATGGAAGGGACATGTATGTTGATCAGGA

ACTGGACATAAACCGTTTATCTGATTACGACGTCGATCACATTGTACCCCAATCCTTTTTGA

AGGACGATTCAATCGACAATAAAGTGCTTACACGCTCGGATAAGAACCGAGGGAAAAGTGAC

AATGTTCCAAGCGAGGAAGTCGTAAAGAAAATGAAGAACTATTGGCGGCAGCTCCTAAATGC

GAAACTGATAACGCAAAGAAAGTTCGATAACTTAACTAAAGCTGAGAGGGGTGGCTTGTCTG

AACTTGACAAGGCCGGATTTATTAAACGTCAGCTCGTGGAAACCCGCCAAATCACAAAGCAT

GTTGCACAGATACTAGATTCCCGAATGAATACGAAATACGACGAGAACGATAAGCTGATTCG

GGAAGTCAAAGTAATCACTTTAAAGTCAAAATTGGTGTCGGACTTCAGAAAGGATTTTCAAT

TCTATAAAGTTAGGGAGATAAATAACTACCACCATGCGCACGACGCTTATCTTAATGCCGTC

GTAGGGACCGCACTCATTAAGAAATACCCGAAGCTAGAAAGTGAGTTTGTGTATGGTGATTA

CAAAGTTTATGACGTCCGTAAGATGATCGCGAAAAGCGAACAGGAGATAGGCAAGGCTACAG

CCAAATACTTCTTTTATTCTAACATTATGAATTTCTTTAAGACGGAAATCACTCTGGCAAAC

GGAGAGATACGCAAACGACCTTTAATTGAAACCAATGGGGAGACAGGTGAAATCGTATGGGA

TAAGGGCCGGGACTTCGCGACGGTGAGAAAAGTTTTGTCCATGCCCCAAGTCAACATAGTAA

AGAAAACTGAGGTGCAGACCGGAGGGTTTTCAAAGGAATCGATTCTTCCAAAAAGGAATAGT

GATAAGCTCATCGCTCGTAAAAAGGACTGGGACCCGAAAAAGTACGGTGGCTTCGATAGCCC

TACAGTTGCCTATTCTGTCCTAGTAGTGGCAAAAGTTGAGAAGGGAAAATCCAAGAAACTGA

AGTCAGTCAAAGAATTATTGGGGATAACGATTATGGAGCGCTCGTCTTTTGAAAAGAACCCC

ATCGACTTCCTTGAGGCGAAAGGTTACAAGGAAGTAAAAAAGGATCTCATAATTAAACTACC

AAAGTATAGTCTGTTTGAGTTAGAAAATGGCCGAAAACGGATGTTGGCTAGCGCCGGAGAGC

TTCAAAAGGGGAACGAACTCGCACTACCGTCTAAATACGTGAATTTCCTGTATTTAGCGTCC

-continued

CATTACGAGAAGTTGAAAGGTTCACCTGAAGATAACGAACAGAAGCAACTTTTTGTTGAGCA

GCACAAACATTATCTCGACGAAATCATAGAGCAAATTTCGGAATTCAGTAAGAGAGTCATCC

TAGCTGATGCCAATCTGGACAAAGTATTAAGCGCATACAACAAGCACAGGGATAAACCCATA

CGTGAGCAGGCGGAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAG

ACGCGACACTGATTCACCAATCCATCACGGGATTATATGAAACTCGGATAGATTTGTCACAG

CTTGGGGGTGACGGATCCCCCAAGAAGAAGAGGAAAGTCTCGAGCGACTACAAAGACCATGA

CGGTGATTATAAAGATCATGACATCGATTACAAGGATGACGATGACAAGGCTGCAGGA (SEQ ID NO: 181)

MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (single underline: HNH domain; double underline: RuvC domain)

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows).

(SEQ ID NO: 182)

ATGGATAAGAAATACTCAATAGGCTTAGATATCGGCACAAATAGCGTCGGATGGGCGGTGAT

CACTGATGAATATAAGGTTCCGTCTAAAAAGTTCAAGGTTCTGGGAAATACAGACCGCCACA

GTATCAAAAAAAATCTTATAGGGGCTCTTTTATTTGACAGTGGAGAGACAGCGGAAGCGACT

-continued

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGTAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAACCTACAATCAATTATTTGAAGAAAACCCTATTAACGCAAGTGGAGTAGA

TGCTAAAGCGATTCTTTCTGCACGATTGAGTAAATCAAGACGATTAGAAAATCTCATTGCTC

AGCTCCCCGGTGAGAAGAAAAATGGCTTATTTGGGAATCTCATTGCTTTGTCATTGGGTTTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATACT

GAAATAACTAAGGCTCCCCTATCAGCTTCAATGATTAAACGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAAGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGTACCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGAGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGACATTCAAAAAGCACAAGTGTCTGGACAAGGCGATAGTTTACATGAACATA

TTGCAAATTTAGCTGGTAGCCCTGCTATTAAAAAAGGTATTTTACAGACTGTAAAAGTTGTT

GATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAG

AAGGTATCAAAGAATTAGGAAGTCAGATTCTTAAAGAGCATCCTGTTGAAAATACTCAATTG

CAAAATGAAAAGCTCTATCTCTATTATCTCCAAAATGGAAGAGACATGTATGTGGACCAAGA

ATTAGATATTAATCGTTTAAGTGATTATGATGTCGATCACATTGTTCCACAAAGTTTCCTTA

AAGACGATTCAATAGACAATAAGGTCTTAACGCGTTCTGATAAAAATCGTGGTAAATCGGAT

AACGTTCCAAGTGAAGAAGTAGTCAAAAAGATGAAAAACTATTGGAGACAACTTCTAAACGC

-continued

CAAGTTAATCACTCAACGTAAGTTTGATAATTTAACGAAAGCTGAACGTGGAGGTTTGAGTG

AACTTGATAAAGCTGGTTTTATCAAACGCCAATTGGTTGAAACTCGCCAAATCACTAAGCAT

GTGGCACAAATTTTGGATAGTCGCATGAATACTAAATACGATGAAAATGATAAACTTATTCG

AGAGGTTAAAGTGATTACCTTAAAATCTAAATTAGTTTCTGACTTCCGAAAAGATTTCCAAT

TCTATAAAGTACGTGAGATTAACAATTACCATCATGCCCATGATGCGTATCTAAATGCCGTC

GTTGGAACTGCTTTGATTAAGAAATATCCAAAACTTGAATCGGAGTTTGTCTATGGTGATTA

TAAAGTTTATGATGTTCGTAAAATGATTGCTAAGTCTGAGCAAGAAATAGGCAAAGCAACCG

CAAAATATTTCTTTTACTCTAATATCATGAACTTCTTCAAAACAGAAATTACACTTGCAAAT

GGAGAGATTCGCAAACGCCCTCTAATCGAAACTAATGGGGAAACTGGAGAAATTGTCTGGGA

TAAAGGGCGAGATTTTGCCACAGTGCGCAAAGTATTGTCCATGCCCCAAGTCAATATTGTCA

AGAAAACAGAAGTACAGACAGGCGGATTCTCCAAGGAGTCAATTTTACCAAAAAGAAATTCG

GACAAGCTTATTGCTCGTAAAAAAGACTGGGATCCAAAAAAATATGGTGGTTTTGATAGTCC

AACGGTAGCTTATTCAGTCCTAGTGGTTGCTAAGGTGGAAAAAGGGAAATCGAAGAAGTTAA

AATCCGTTAAAGAGTTACTAGGGATCACAATTATGGAAAGAAGTTCCTTTGAAAAAAATCCG

ATTGACTTTTTAGAAGCTAAAGGATATAAGGAAGTTAAAAAAGACTTAATCATTAAACTACC

TAAATATAGTCTTTTTGAGTTAGAAAACGGTCGTAAACGGATGCTGGCTAGTGCCGGAGAAT

TACAAAAAGGAAATGAGCTGGCTCTGCCAAGCAAATATGTGAATTTTTTATATTTAGCTAGT

CATTATGAAAAGTTGAAGGGTAGTCCAGAAGATAACGAACAAAAACAATTGTTTGTGGAGCA

GCATAAGCATTATTTAGATGAGATTATTGAGCAAATCAGTGAATTTTCTAAGCGTGTTATTT

TAGCAGATGCCAATTTAGATAAAGTTCTTAGTGCATATAACAAACATAGAGACAAACCAATA

CGTGAACAAGCAGAAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAG

ATGCCACTCTTATCCATCAATCCATCACTGGTCTTTATGAAACACGCATTGATTTGAGTCAG

CTAGGAGGTGACTGA (SEQ ID NO: 183)

MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

-continued

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

(SEQ ID NO: 184)

MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (single underline: HNH domain; double underline: RuvC domain).

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

Exemplary Catalytically Inactive Cas9 (dCas9):

(SEQ ID NO: 185)

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

-continued

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary Catalytically Cas9 Nickase (nCas9):

(SEQ ID NO: 186)

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

-continued

```
TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD
```

Exemplary Catalytically Active Cas9:

```
                                         (SEQ ID NO: 187)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD.
```

In some embodiments, Cas9 refers to a Cas9 from archaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In particular embodiments, napDNAbps useful in the methods of the invention include circular permutants, which are known in the art and described, for example, by Oakes et al., Cell 176, 254-267, 2019. An exemplary circular permutant follows where the bold sequence indicates sequence derived from Cas9, the italics sequence denotes a linker sequence, and the underlined sequence denotes a bipartite nuclear localization sequence, CP5 (with MSP "NGC=Pam Variant with mutations Regular Cas9 likes NGG" PID=Protein Interacting Domain and "D10A" nickase):

(SEQ ID NO: 172)*

EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFMQPTVAYSVLVVAKVEKGKSKKLKSVKELLGITIMERSSFEKN

PIDFLEAKGYKEVKKDLIIKLPKYSLFELENGRKRMLASAKFLQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPRAFKYF

DTTIARKEYRSTKEVLDATLIHQSITGLYETRIDLSQLGGD*GGSGGSGGS*

*GGSGGSGGSGGM*DKKYSIGLAIGTNSVGWAVITDEYKVPSKKFKVLGNTD

RHSIKKNLIGALLFDSGETAEATRLKRTARRRYTRRKNRICYLQEIFSNE

MAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLV

QTYNQLFEENPINASGVDAKAILSARLSKSRRLENLIAQLPGEKKNGLFG

NLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEEL

LVKLNREDLLRKQRTFDNGSIPHQIHLGELHAILRRQEDFYPFLKDNREK

IEKILTFRIPYYVGPLARGNSRFAWMTRKSEETITPWNFEEVVDKGASAQ

SFIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLLNA

-continued

KLITQRKFDNLTKAERGGLSELDKAGFIKRQLVETRQITKHVAQILDSRM

NTKYDENDKLIREVKVITLKSKLVSDFRKDFQFYKVREINNYHHAHDAYL

NAVVGTALIKKYPKLESEFVYGDYKVYDVRKMIAKSEQEGADKRTADGSE

FESPKKKRKV

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN).

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that Cas12b/C2c1, CasX and CasY from other bacterial species may also be used in accordance with the present disclosure.

Cas12b/C2c1 (uniprot.org/uniprot/T0D7A2#2)
sp|T0D7A2|C2C1_ALIAG CRISPR-associated endo- nuclease C2c1 OS = *Alicyclobacillus acido-terrestris* (strain ATCC 49025/DSM 3922/ CIP 106132/NCIMB 13137/GD3B) GN = c2c1 PE = 1 SV = 1

(SEQ ID NO: 188)

MAVKSIKVKLRLDDMPEIRAGLWKLHKEVNAGVRYYTEWLSLLRQENLYRRSPNGDGEQECD

KTAEECKAELLERLRARQVENGHRGPAGSDDELLQLARQLYELLVPQAIGAKGDAQQIARKF

LSPLADKDAVGGLGIAKAGNKPRWVRMREAGEPGWEEEKEKAETRKSADRTADVLRALADFG

LKPLMRVYTDSEMSSVEWKPLRKGQAVRTWDRDMFQQAIERMMSWESWNQRVGQEYAKLVEQ

KNRFEQKNFVGQEHLVHLVNQLQQDMKEASPGLESKEQTAHYVTGRALRGSDKVFEKWGKLA

PDAPFDLYDAEIKNVQRRNTRRFGSHDLFAKLAEPEYQALWREDASFLTRYAVYNSILRKLN

HAKMFATFTLPDATAHPIWTRFDKLGGNLHQYTFLFNEFGERRHAIRFHKLLKVENGVAREV

DDVTVPISMSEQLDNLLPRDPNEPIALYFRDYGAEQHFTGEFGGAKIQCRRDQLAHMHRRRG

ARDVYLNVSVRVQSQSEARGERRPPYAAVFRLVGDNHRAFVHFDKLSDYLAEHPDDGKLGSE

GLLSGLRVMSVDLGLRTSASISVFRVARKDELKPNSKGRVPFFFPIKGNDNLVAVHERSQLL

KLPGETESKDLRAIREERQRTLRQLRTQLAYLRLLVRCGSEDVGRRERSWAKLIEQPVDAAN

HMTPDWREAFENELQKLKSLHGICSDKEWMDAVYESVRRVWRHMGKQVRDWRKDVRSGERPK

IRGYAKDVVGGNSIEQIEYLERQYKFLKSWSFFGKVSGQVIRAEKGSRFAITLREHIDHAKE

DRLKKLADRIIMEALGYVYALDERGKGKWVAKYPPCQLILLEELSEYQFNNDRPPSENNQLM

QWSHRGVFQELINQAQVHDLLVGTMYAAFSSRFDARTGAPGIRCRRVPARCTQEHNPEPFPW

WLNKFVVEHTLDACPLRADDLIPTGEGEIFVSPFSAEEGDFHQIHADLNAAQNLQQRLWSDF

DISQIRLRCDWGEVDGELVLIPRLTGKRTADSYSNKVFYTNTGVTYYERERGKKRRKVFAQE

KLSEEEAELLVEADEAREKSVVLMRDPSGIINRGNWTRQKEFWSMVNQRIEGYLVKQIRSR

VPLQDSACENTGDI

CasX (uniprot.org/uniprot/F0NN87; uniprot.org/uniprot/F0NH53)
>tr|F0NN87|F0NN87_SULIH CRISPR-associated Casx protein OS = *Sulfolobus islandicus* (strain HVE10/4) GN = SiH_0402 PE = 4 SV = 1

(SEQ ID NO: 189)

MEVPLYNIFGDNYIIQVATEAENSTIYNNKVEIDDEELRNVLNLAYKIAKNNEDAAAERRGK

AKKKKGEEGETTTSNIILPLSGNDKNPWTETLKCYNFPTTVALSEVFKNFSQVKECEEVSAP

SFVKPEFYEFGRSPGMVERTRRVKLEVEPHYLIIAAAGWVLTRLGKAKVSEGDYVGVNVFTP

TRGILYSLIQNVNGIVPGIKPETAFGLWIARKVVSSVTNPNVSVVRIYTISDAVGQNPTTIN

GGFSIDLTKLLEKRYLLSERLEAIARNALSISSNMRERYIVLANYIYEYLTGSKRLEDLLY

FANRDLIMNLNSDDGKVRDLKLISAYVNGELIRGEG

-continued

>tr|F0NH53|F0NH53_SULIR CRISPR associated protein, Casx OS = *Sulfolobus islandicus* (strain REY15A) GN = SiRe_0771 PE = 4 SV = 1

(SEQ ID NO: 190)

MEVPLYNIFGDNYIIQVATEAENSTIYNNKVEIDDEELRNVLNLAYKIAKNNEDAAAERRGK

AKKKKGEEGETTTSNIILPLSGNDKNPWTETLKCYNFPTTVALSEVFKNFSQVKECEEVSAP

SFVKPEFYKFGRSPGMVERTRRVKLEVEPHYLIMAAAGWVLTRLGKAKVSEGDYVGVNVFTP

TRGILYSLIQNVNGIVPGIKPETAFGLWIARKVVSSVTNPNVSVVSIYTISDAVGQNPTTIN

GGFSIDLTKLLEKRDLLSERLEAIARNALSISSNMRERYIVLANYIYEYLTGSKRLEDLLYF

ANRDLIMNLNSDDGKVRDLKLISAYVNGELIRGEG

Deltaproteobacteria CasX (SEQ ID NO: 191)

MEKRINKIRKKLSADNATKPVSRSGPMKTLLVRVMTDDLKKRLEKRRKKPEVMPQVISNNAA

NNLRMLLDDYTKMKEAILQVYWQEFKDDHVGLMCKFAQPASKKIDQNKLKPEMDEKGNLTTA

GFACSQCGQPLFVYKLEQVSEKGKAYTNYFGRCNVAEHEKLILLAQLKPVKDSDEAVTYSLG

KFGQRALDFYSIHVTKESTHPVKPLAQIAGNRYASGPVGKALSDACMGTIASFLSKYQDIII

EHQKVVKGNQKRLESLRELAGKENLEYPSVTLPPQPHTKEGVDAYNEVIARVRMWVNLNLWQ

KLKLSRDDAKPLLRLKGFPSFPVVERRENEVDWWNTINEVKKLIDAKRDMGRVFWSGVTAEK

RNTILEGYNYLPNENDHKKREGSLENPKKPAKRQFGDLLLYLEKKYAGDWGKVFDEAWERID

KKIAGLTSHIEREEARNAEDAQSKAVLTDWLRAKASFVLERLKEMDEKEFYACEIQLQKWYG

DLRGNPFAVEAENRVVDISGFSIGSDGHSIQYRNLLAWKYLENGKREFYLLMNYGKKGRIRF

TDGTDIKKSGKWQGLLYGGGKAKVIDLTFDPDDEQLIILPLAFGTRQGREFIWNDLLSLETG

LIKLANGRVIEKTIYNKKIGRDEPALFVALTFERREVVDPSNIKPVNLIGVARGENIPAVIA

LTDPEGCPLPEFKDSSGGPTDILRIGEGYKEKQRAIQAAKEVEQRRAGGYSRKFASKSRNLA

DDMVRNSARDLFYHAVTHDAVLVFANLSRGFGRQGKRTFMTERQYTKMEDWLTAKLAYEGLT

SKTYLSKTLAQYTSKTCSNCGFTITYADMDVMLVRLKKTSDGWATTLNNKELKAEYQITYYN

RYKRQTVEKELSAELDRLSEESGNNDISKWTKGRRDEALFLLKKRFSHRPVQEQFVCLDCGH

EVHAAEQAALNIARSWLFLNSNSTEFKSYKSGKQPFVGAWQAFYKRRLKEVWKPNA

CasY (ncbi.nlm.nih.gov/protein/APG80656.1)
>APG80656.1 CRISPR-associated protein CasY (uncultured *Parcubacteria* group bacterium]

(SEQ ID NO: 192)

MSKRHPRISGVKGYRLHAQRLEYTGKSGAMRTIKYPLYSSPSGGRTVPREIVSAINDDYVGL

YGLSNFDDLYNAEKRNEEKVYSVLDFWYDCVQYGAVFSYTAPGLLKNVAEVRGGSYELTKTL

KGSHLYDELQIDKVIKFLNKKEISRANGSLDKLKKDIIDCFKAEYRERHKDQCNKLADDIKN

AKKDAGASLGERQKKLFRDFFGISEQSENDKPSFTNPLNLTCCLLPFDTVNNNRNRGEVLEN

KLKEYAQKLDKNEGSLEMWEYIGIGNSGTAFSNFLGEGFLGRLRENKITELKKAMMDITDAW

RGQEQEEELEKRLRILAALTIKLREPKFDNHWGGYRSDINGKLSSWLQNYINQTVKIKEDLK

GHKKDLKKAKEMINRFGESDTKEEAVVSSLLESIEKIVPDDSADDEKPDIPAIAIYRRFLSD

GRLTLNRFVQREDVQEALIKERLEAEKKKKPKKRKKKSDAEDEKETIDFKELFPHLAKPLKL

VPNFYGDSKRELYKKYKNAAIYTDALWKAVEKIYKSAFSSSLKNSFFDTDFDKDFFIKRLQK

IFSVYRRFNTDKWKPIVKNSFAPYCDIVSLAENEVLYKPKQSRSRKSAAIDKNRVRLPSTEN

IAKAGIALARELSVAGFDWKDLLKKEEHEEYIDLIELHKTALALLLAVTETQLDISALDFVE

NGTVKDFMKTRDGNLVLEGRFLEMFSQSIVFSELRGLAGLMSRKEFITRSAIQTMNGKQAEL

LYIPHEFQSAKITTPKEMSRAFLDLAPAEFATSLEPESLSEKSLLKLKQMRYYPHYFGYELT

RTGQGIDGGVAENALRLEKSPVKKREIKCKQYKTLGRGQNKIVLYVRSSYYQTQFLEWFLHR

-continued

```
PKNVQTDVAVSGSFLIDEKKVKTRWNYDALTVALEPVSGSERVFVSQPFTIFPEKSAEEEGQ

RYLGIDIGEYGIAYTALEITGDSAKILDQNFISDPQLKTLREEVKGLKLDQRRGTFAMPSTK

IARIRESLVHSLRNRIHHLALKHKAKIVYELEVSRFEEGKQKIKKVYATLKKADVYSEIDAD

KNLQTTVWGKLAVASEISASYTSQFCGACKKLWRAEMQVDETITTQELIGTVRVIKGGTLID

AIKDFMRPPIFDENDTPFPKYRDFCDKHHISKKMRGNSCLFICPFCRANADADIQASQTIAL

LRYVKEEKKVEDYFERFRKLKNIKVLGQMKKI
```

The term "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz, G. E. and Schirmer, R. H., Principles of Protein Structure, Springer-Verlag, New York (1979)). According to such analyses, groups of amino acids can be defined where amino acids within a group exchange preferentially with each other, and therefore resemble each other most in their impact on the overall protein structure (Schulz, G. E. and Schirmer, R. H., supra). Non-limiting examples of conservative mutations include amino acid substitutions of amino acids, for example, lysine for arginine and vice versa such that a positive charge can be maintained; glutamic acid for aspartic acid and vice versa such that a negative charge can be maintained; serine for threonine such that a free —OH can be maintained; and glutamine for asparagine such that a free —$NH_2$ can be maintained.

The term "coding sequence" or "protein coding sequence" as used interchangeably herein refers to a segment of a polynucleotide that codes for a protein. The region or sequence is bounded nearer the 5' end by a start codon and nearer the 3' end with a stop codon. Coding sequences can also be referred to as open reading frames.

By "cytidine deaminase" is meant a polypeptide or fragment thereof capable of catalyzing a deamination reaction that converts an amino group to a carbonyl group. In one embodiment, the cytidine deaminase converts cytosine to uracil or 5-methylcytosine to thymine. The cytidine deaminase (e.g., engineered cytidine deaminase, evolved cytidine deaminase) provided herein can be from any organism, such as a bacterium.

In some embodiments, a cytidine deaminase of a base editor can comprise all or a portion of an apolipoprotein B mRNA editing complex (APOBEC) family deaminase. APOBEC is a family of evolutionarily conserved cytidine deaminases. Members of this family are C-to-U editing enzymes. In some embodiments, the cytidine deaminase includes, without limitation: APOBEC family members, including but not limited to: APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, Activation-induced (cytidine) deaminase (AID), hAPOBEC1, which is derived from *Homo sapiens*, rAPOBEC1, which is derived from *Rattus norvegicus*, ppAPOBEC1, which is derived from *Pongo pygmaeus*, AmAPOBEC1 (BEM3.31), derived from *Alligator mississippiensis*, oCAPOBEC1, which is derived from *Oryctolagus cuniculus*, SsAPOBEC2 (BEM3.39), which is derived from *Sus scrofa*, hAPOBEC3A, which is derived from *Homo sapiens*, maAPOBEC1, which is derived from *Mesocricetus auratus*, mdAPOBEC1, which is derived from *Monodelphis domestica*; cytidine deaminase 1 (CDA1), hA3A, which is APOBEC3A derived from *Homo sapiens*, RrA3F (BEM3.14), which is APOBEC3F derived from *Rhinopithecus roxellana*; PmCDA1, which is derived from *Petromyzon marinus* (*Petromyzon marinus* cytosine deaminase 1, "PmCDA1"); AID (Activation-induced cytidine deaminase; AICDA), which is derived from a mammal (e.g., human, swine, bovine, horse, monkey etc.); hAID, which is derived from *Homo sapiens*; and FENRY.

The term "deaminase" or "deaminase domain," as used herein, refers to a protein or enzyme that catalyzes a deamination reaction. In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytosine deaminase, catalyzing the hydrolytic deamination of cytosine to uracil. In some embodiments, the deaminase is an adenosine deaminase, which catalyzes the hydrolytic deamination of adenine to hypoxanthine. In some embodiments, the deaminase is an adenosine deaminase, which catalyzes the hydrolytic deamination of adenosine or adenine (A) to inosine (I). In some embodiments, the deaminase or deaminase domain is an adenosine deaminase catalyzing the hydrolytic deamination of adenosine or deoxyadenosine to inosine or deoxyinosine, respectively. In some embodiments, the adenosine deaminase catalyzes the hydrolytic deamination of adenosine in deoxyribonucleic acid (DNA). The deaminases (e.g., engineered deaminases, evolved deaminases) provided herein can be from any organism, such as a bacterium. In some embodiments, the deaminase is from a bacterium, such as *Escherichia coli, Staphylococcus aureus, Salmonella typhimurium, Shewanella putrefaciens, Haemophilus influenzae*, or *Caulobacter crescentus.*

"Detect" refers to identifying the presence, absence or amount of the analyte to be detected. In one embodiment, a sequence alteration in a polynucleotide or polypeptide is detected. In another embodiment, the presence of indels is detected.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an enzyme linked immunosorbent assay (ELISA)), biotin, digoxigenin, or haptens.

By "disease" is meant any condition or disorder that damages or interferes with the normal function of a cell, tissue, or organ.

The term "effective amount," as used herein, refers to an amount of a biologically active agent that is sufficient to elicit a desired biological response. The effective amount of an active agent(s) used to practice the present invention for therapeutic treatment of a disease varies depending upon the manner of administration, the age, body weight, and general health of the subject. Ultimately, the attending physician or veterinarian will decide the appropriate amount and dosage regimen. Such amount is referred to as an "effective" amount. In one embodiment, an effective amount is the amount of a base editor of the invention (e.g., a fusion protein comprising a programable DNA binding protein, a nucleobase editor and gRNA) sufficient to introduce an alteration in a gene of interest in a cell (e.g., a cell in vitro or in vivo). In some embodiments, an effective amount of a fusion protein provided herein, e.g., of a multi-effector nucleobase editor comprising a nCas9 domain and one or more deaminase domains (e.g., adenosine deaminase, cytidine deaminase) may refer to the amount of the fusion protein that is sufficient to induce editing of a target site specifically bound and edited by the multi-effector nucleobase editors. In one embodiment, an effective amount is the amount of a base editor required to achieve a therapeutic effect (e.g., to reduce or control a disease or a symptom or condition thereof). Such therapeutic effect need not be sufficient to alter a gene of interest in all cells of a subject, tissue or organ, but only to alter a gene of interest in about 1%, 5%, 10%, 25%, 50%, 75% or more of the cells present in a subject, tissue or organ.

In some embodiments, an effective amount of a fusion protein provided herein, e.g., of a nucleobase editor comprising a nCas9 domain and one or more deaminase domains (e.g., adenosine deaminase, cytidine deaminase) refers to the amount of the fusion protein that is sufficient to induce editing of a target site specifically bound and edited by the nucleobase editors described herein. As will be appreciated by the skilled artisan, the effective amount of an agent, e.g., a fusion protein, a nuclease, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and/or on the agent being used.

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

By "guide RNA" or "gRNA" is meant a polynucleotide which can be specific for a target sequence and can form a complex with a polynucleotide programmable nucleotide binding domain protein (e.g., Cas9 or Cpf1). In an embodiment, the guide polynucleotide is a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821 (2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases and Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." An extended gRNA will bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

The term "inhibitor of base repair" or "IBR" refers to a protein that is capable in inhibiting the activity of a nucleic acid repair enzyme, for example a base excision repair (BER) enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 Endo1, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG. In some embodiments, the base repair inhibitor is an inhibitor of Endo V or hAAG. In some embodiments, the base repair inhibitor is a catalytically inactive EndoV or a catalytically inactive hAAG.

In some embodiments, the base repair inhibitor is uracil glycosylase inhibitor (UGI). UGI refers to a protein that is capable of inhibiting a uracil-DNA glycosylase base-excision repair enzyme. In some embodiments, a UGI domain comprises a wild-type UGI or a fragment of a wild-type UGI. In some embodiments, the UGI proteins provided herein include fragments of UGI and proteins homologous to a UGI or a UGI fragment. In some embodiments, the base repair inhibitor is an inhibitor of inosine base excision repair. In some embodiments, the base repair inhibitor is a "catalytically inactive inosine specific nuclease" or "dead inosine specific nuclease. Without wishing to be bound by any particular theory, catalytically inactive inosine glycosylases (e.g., alkyl adenine glycosylase (AAG)) can bind inosine, but cannot create an abasic site or remove the inosine, thereby sterically blocking the newly formed inosine moiety from DNA damage/repair mechanisms. In some embodiments, the catalytically inactive inosine specific nuclease can be capable of binding an inosine in a nucleic acid but does not cleave the nucleic acid. Non-limiting exemplary catalytically inactive inosine specific nucleases include catalytically inactive alkyl adenosine glycosylase (AAG nuclease), for example, from a human, and catalytically inactive endonuclease V (EndoV nuclease), for example, from *E. coli*. In some embodiments, the catalytically inactive AAG nuclease comprises an E125Q mutation or a corresponding mutation in another AAG nuclease.

By "increases" is meant a positive alteration of at least 10%, 25%, 50%, 75%, or 100%.

An "intein" is a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein (e.g., split intein-N and split intein-C). For example, in cyanobacteria, DnaE, the catalytic subunit a of DNA polymerase III, is encoded by two separate genes, dnaE-n and dnaE-c. The intein encoded by the dnaE-n gene may be herein referred as "intein-N." The intein encoded by the dnaE-c gene may be herein referred as "intein-C."

Other intein systems may also be used. For example, a synthetic intein based on the dnaE intein, the Cfa-N (e.g., split intein-N) and Cfa-C (e.g., split intein-C) intein pair, has been described (e.g., in Stevens et al., J Am Chem Soc. 2016 Feb. 24; 138(7):2162-5, incorporated herein by reference). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference.

Exemplary nucleotide and amino acid sequences of inteins are provided.

DnaE Intein-N DNA:
(SEQ ID NO: 193)
TGCCTGTCATACGAAACCGAGATACTGACAGTAGAATATGGCCTTCTGC

CAATCGGGAAGATTGTGGAGAAACGGATAGAATGCACAGTTTACTCTGT

CGATAACAATGGTAACATTTATACTCAGCCAGTTGCCCAGTGGCACGAC

CGGGGAGAGCAGGAAGTATTCGAATACTGTCTGGAGGATGGAAGTCTCA

TTAGGGCCACTAAGGACCACAAATTTATGACAGTCGATGGCCAGATGCT

GCCTATAGACGAAATCTTTGAGCGAGAGTTGGACCTCATGCGAGTTGAC

AACCTTCCTAAT

DnaE Intein-N Protein:
(SEQ ID NO: 194)
CLSYETEILTVEYGLLPIGKIVEKRIECTVYSVDNNGNIYTQPVAQWHD

RGEQEVFEYCLEDGSLIRATKDHKFMTVDGQMLPIDEIFERELDLMRVD

NLPN

DnaE Intein-C DNA:
(SEQ ID NO: 195)
ATGATCAAGATAGCTACAAGGAAGTATCTTGGCAAACAAAACGTTTATG

ATATTGGAGTCGAAAGAGATCACAACTTTGCTCTGAAGAACGGATTCAT

AGCTTCTAAT

Intein-C:
(SEQ ID NO: 196)
MIKIATRKYLGKQNVYDIGVERDHNFALKNGFIASN

Cfa-N DNA:
(SEQ ID NO: 197)
TGCCTGTCTTATGATACCGAGATACTTACCGTTGAATATGGCTTCTTGC

CTATTGGAAAGATTGTCGAAGAGAGAATTGAATGCACAGTATATACTGT

AGACAAGAATGGTTTCGTTTACACACAGCCCATTGCTCAATGGCACAAT

-continued

CGCGGCGAACAAGAAGTATTTGAGTACTGTCTCGAGGATGGAAGCATCA

TACGAGCAACTAAAGATCATAAATTCATGACCACTGACGGGCAGATGTT

GCCAATAGATGAGATATTCGAGCGGGGCTTGGATCTCAAACAAGTGGAT

GGATTGCCA

Cfa-N Protein:
(SEQ ID NO: 198)
CLSYDTEILTVEYGFLPIGKIVEERIECTVYTVDKNGFVYTQPIAQWHN

RGEQEVFEYCLEDGSIIRATKDHKFMTTDGQMLPIDEIFERGLDLKQVD

GLP

Cfa-C DNA:
(SEQ ID NO: 199)
ATGAAGAGGACTGCCGATGGATCAGAGTTTGAATCTCCCAAGAAGAAGA

GGAAAGTAAAGATAATATCTCGAAAAAGTCTTGGTACCCAAAATGTCTA

TGATATTGGAGTGGAGAAAGATCACAACTTCCTTCTCAAGAACGGTCTC

GTAGCCAGCAAC

Cfa-C Protein:
(SEQ ID NO: 200)
MKRTADGSEFESPKKKRKVKIISRKSLGTQNVYDIGVEKDHNFLLKNGL

VASN

Intein-N and intein-C may be fused to the N-terminal portion of the split Cas9 and the C-terminal portion of the split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N—[N-terminal portion of the split Cas9]-[intein-N]—C. In some embodiments, an intein-C is fused to the N-terminus of the C-terminal portion of the split Cas9, i.e., to form a structure of N-[intein-C]—[C-terminal portion of the split Cas9]-C. The mechanism of intein-mediated protein splicing for joining the proteins the inteins are fused to (e.g., split Cas9) is known in the art, e.g., as described in Shah et al., Chem Sci. 2014; 5 (1): 446-461, incorporated herein by reference. Methods for designing and using inteins are known in the art and described, for example by WO2014004336, WO2017132580, US20150344549, and US20180127780, each of which is incorporated herein by reference in their entirety.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high-performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker," as used herein, can refer to a covalent linker (e.g., covalent bond), a non-covalent linker, a chemical group, or a molecule linking two molecules or moieties, e.g., two components of a protein complex or a ribonucleocomplex, or two domains of a fusion protein, such as, for example, a polynucleotide programmable DNA binding domain (e.g., dCas9) and one or more deaminase domains (e.g., an adenosine deaminase and/or a cytidine deaminase). A linker can join different components of, or different portions of components of, a base editor system. For example, in some embodiments, a linker can join a guide polynucleotide binding domain of a polynucleotide programmable nucleotide binding domain and a catalytic domain of a deaminase. In some embodiments, a linker can join a CRISPR polypeptide and a deaminase. In some embodiments, a linker can join a Cas9 and a deaminase. In some embodiments, a linker can join a dCas9 and a deaminase. In some embodiments, a linker can join a nCas9 and a deaminase. In some embodiments, a linker can join a guide polynucleotide and a deaminase. In some embodiments, a linker can join a deaminating component and a polynucleotide programmable nucleotide binding component of a base editor system. In some embodiments, a linker can join a RNA-binding portion of a deaminating component and a polynucleotide programmable nucleotide binding component of a base editor system. In some embodiments, a linker can join a RNA-binding portion of a deaminating component and a RNA-binding portion of a polynucleotide programmable nucleotide binding component of a base editor system. A linker can be positioned between, or flanked by, two groups, molecules, or other moieties and connected to each one via a covalent bond or non-covalent interaction, thus connecting the two. In some embodiments, the linker can be an organic molecule, group, polymer, or chemical moiety. In some embodiments, the linker can be a polynucleotide. In some embodiments, the linker can be a DNA linker. In some embodiments, the linker can be a RNA linker. In some embodiments, a linker can comprise an aptamer capable of binding to a ligand. In some embodiments, the ligand may be carbohydrate, a peptide, a protein, or a nucleic acid. In some embodiments, the linker may comprise an aptamer may be derived from a riboswitch. The riboswitch from which the aptamer is derived may be selected from a theophylline riboswitch, a thiamine pyrophosphate (TPP) riboswitch, an adenosine cobalamin (AdoCbl) riboswitch, an S-adenosyl methionine (SAM) riboswitch, an SAH riboswitch, a flavin mononucleotide (FMN) riboswitch, a tetrahydrofolate riboswitch, a lysine riboswitch, a glycine riboswitch, a purine riboswitch, a GlmS riboswitch, or a pre-queosinel (PreQ1) riboswitch. In some embodiments, a linker may comprise an aptamer bound to a polypeptide or a protein domain, such as a polypeptide ligand. In some embodiments, the polypeptide ligand may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif. In some embodiments, the polypeptide ligand may be a portion of a base editor system component. For example, a nucleobase editing component may comprise one or more deaminase domains and a RNA recognition motif.

In some embodiments, the linker can be an amino acid or a plurality of amino acids (e.g., a peptide or protein). In some embodiments, the linker can be about 5-100 amino acids in length, for example, about 5, 6, 7, 8, 9, 10, 11, 12, 13, 14, 15, 16, 17, 18, 19, 20, 20-30, 30-40, 40-50, 50-60, 60-70, 70-80, 80-90, or 90-100 amino acids in length. In some embodiments, the linker can be about 100-150, 150-200, 200-250, 250-300, 300-350, 350-400, 400-450, or 450-500 amino acids in length. Longer or shorter linkers can be also contemplated.

In some embodiments, a linker joins a gRNA binding domain of an RNA-programmable nuclease, including a Cas9 nuclease domain, and the catalytic domain of a nucleic-acid editing protein (e.g., cytidine and/or adenosine deaminase). In some embodiments, a linker joins a dCas9 and a nucleic-acid editing protein. For example, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated.

In some embodiments, the domains of the nucleobase editor (e.g., multi-effector nucleobase editor) are fused via a linker that comprises the amino acid sequence of SGGSSGSETPGTSESATPESSGGS (SEQ ID NO: 201), SGGSSGGSSGSETPGTSESATPESSGGSSGGS (SEQ ID NO: 202), or GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS (SEQ ID NO: 203). In some embodiments, domains of the nucleobase editor (e.g., multi-effector nucleobase editor) are fused via a linker comprising the amino acid sequence SGSETPGTSESATPES (SEQ ID NO: 204), which may also be referred to as the XTEN linker. In some embodiments, a linker comprises the amino acid sequence SGGS (SEQ ID NO: 205). In some embodiments, a linker comprises $(SGGS)_n$ (SEQ ID NO: 206), $(GGGS)_n$ (SEQ ID NO: 207), $(GGGGS)_n$ (SEQ ID NO: 208), $(G)_n$ (SEQ ID NO: 209), $(EAAAK)_n$ (SEQ ID NO: 210), $(GGS)_n$ (SEQ ID NO: 211), SGSETPGTSESATPES (SEQ ID NO: 204), or $(XP)_n$ motif (SEQ ID NO: 212), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

In some embodiments, the linker is 24 amino acids in length. In some embodiments, the linker comprises the amino acid sequence SGGSSGGSSGSETPGTSESATPES (SEQ ID NO: 213). In some embodiments, the linker is 40 amino acids in length. In some embodiments, the linker comprises the amino acid sequence SGGSSGGSSG-SETPGTSESATPESSGGSSGGSSGGSSGGS (SEQ ID NO: 214). In some embodiments, the linker is 64 amino acids in length. In some embodiments, the linker comprises the amino acid sequence SGGSSGGSSGSETPGTSESAT-PESSGGSSGGSSGGSSGGSSGSETPGTSESAT-PESSGGS SGGS (SEQ ID NO: 215). In some embodiments, the linker is 92 amino acids in length. In some embodiments, the linker comprises the amino acid sequence

```
                                        (SEQ ID NO: 216)
PGSPAGSPTSTEEGTSESATPESGPGTSTEPSEGSAPGSPAGSPTSTEE
GTSTEPSEGSAPGTSTEPSEGSAPGTSESATPESGPGSEPATS.
```

By "marker" is meant any protein or polynucleotide having an alteration in expression level or activity that is associated with a disease or disorder.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, Molecular Cloning: A Laboratory Manual (4th ed., Cold Spring Harbor Laboratory Press, Cold Spring Harbor, N.Y. (2012)). In some embodiments, the presently disclosed base editors can efficiently generate an "intended mutation," such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., cytidine base editor and/or adenosine base editor) bound to a guide polynucleotide (e.g., gRNA), specifically designed to generate the intended mutation.

In general, mutations made or identified in a sequence (e.g., an amino acid sequence as described herein) are numbered in relation to a reference (or wild-type) sequence, i.e., a sequence that does not contain the mutations. The skilled practitioner in the art would readily understand how to determine the position of mutations in amino acid and nucleic acid sequences relative to a reference sequence.

The term "non-conservative mutations" involve amino acid substitutions between different groups, for example, lysine for tryptophan, or phenylalanine for serine, etc. In this case, it is preferable for the non-conservative amino acid substitution to not interfere with, or inhibit the biological activity of, the functional variant. The non-conservative amino acid substitution can enhance the biological activity of the functional variant, such that the biological activity of the functional variant is increased as compared to the wild-type protein.

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 217), KRPAATKKAGQAKKKK (SEQ ID NO: 218), KKTELQTTNAENKTKKL (SEQ ID NO: 219), KRGINDRNFWRGENGRKTR (SEQ ID NO: 220), RKSG-KIAAIVVKRPRK (SEQ ID NO: 221), PKKKRKV (SEQ ID NO: 222), or MDSLLMNRRKFLYQFKNVRWAKGR-RETYLC (SEQ ID NO: 223).

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (2'-e.g., fluororibose, ribose, 2'-deoxyribose, arabinose, and hexose); and/or modified phosphate groups (e.g., phosphorothioates and 5'-N-phosphoramidite linkages).

The term "nucleic acid programmable DNA binding protein" or "napDNAbp" may be used interchangeably with "polynucleotide programmable nucleotide binding domain" to refer to a protein that associates with a nucleic acid (e.g., DNA or RNA), such as a guide nucleic acid or guide polynucleotide (e.g., gRNA), that guides the napDNAbp to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. A Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" *CRISPRJ.* 2018 October; 1:325-336. doi: 10.1089/crispr.2018.0033; Yan et al., "Functionally diverse type V CRISPR-Cas systems" *Science.* 2019 Jan. 4; 363(6422):88-91. doi: 10.1126/science.aav7271, the entire contents of each are hereby incorporated by reference.

The term "nucleobase," "nitrogenous base," or "base," used interchangeably herein, refers to a nitrogen-containing biological compound that forms a nucleoside, which in turn is a component of a nucleotide. The ability of nucleobases to form base pairs and to stack one upon another leads directly to long-chain helical structures such as ribonucleic acid (RNA) and deoxyribonucleic acid (DNA). Five nucleobases—adenine (A), cytosine (C), guanine (G), thymine (T), and uracil (U)—are called primary or canonical. Adenine and guanine are derived from purine, and cytosine, uracil, and thymine are derived from pyrimidine. DNA and RNA can also contain other (non-primary) bases that are modified. Non-limiting exemplary modified nucleobases can include hypoxanthine, xanthine, 7-methylguanine, 5,6-dihydrouracil, 5-methylcytosine (m5C), and 5-hydromethylcytosine. Hypoxanthine and xanthine can be created through mutagen presence, both of them through deamination (replacement of the amine group with a carbonyl group). Hypoxanthine can be modified from adenine. Xanthine can be modified from guanine. Uracil can result from deamination of cytosine. A "nucleoside" consists of a nucleobase and a five carbon sugar (either ribose or deoxyribose). Examples of a nucleoside include adenosine, guanosine, uridine, cytidine, 5-methyluridine (m5U), deoxyadenosine, deoxyguanosine, thymidine, deoxyuridine, and deoxycytidine. Examples of a nucleoside with a modified nucleobase includes inosine (I), xanthosine (X), 7-methylguanosine (m7G), dihydrouridine (D), 5-methylcytidine (m5C), and pseudouridine (P). A "nucleotide" consists of a nucleobase, a five carbon sugar (either ribose or deoxyribose), and at least one phosphate group.

The terms "nucleobase editing domain" or "nucleobase editing protein," as used herein, refers to a protein or enzyme that can catalyze a nucleobase modification in RNA or DNA, such as cytosine (or cytidine) to uracil (or uridine) or thymine (or thymidine), and adenine (or adenosine) to hypoxanthine (or inosine) deaminations, as well as non-templated nucleotide additions and insertions. In some embodiments, the nucleobase editing domain is a deaminase domain (e.g., an adenine deaminase or an adenosine deaminase; or a cytidine deaminase or a cytosine deaminase). In some embodiments, the nucleobase editing domain is more than one deaminase domain (e.g., an adenine deaminase or an adenosine deaminase and a cytidine or a cytosine deaminase). In some embodiments, the nucleobase editing domain can be a naturally occurring nucleobase editing domain. In some embodiments, the nucleobase editing domain can be an engineered or evolved nucleobase editing domain from the naturally occurring nucleobase editing domain. The nucleobase editing domain can be from any organism, such as a bacterium, human, chimpanzee, gorilla, monkey, cow, dog, rat, or mouse.

As used herein, "obtaining" as in "obtaining an agent" includes synthesizing, purchasing, or otherwise acquiring the agent.

A "patient" or "subject" as used herein refers to a mammalian subject or individual diagnosed with, at risk of having or developing, or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, camels, llamas, goats, sheep, rodents (e.g., mice, rabbits, rats, or guinea pigs) and other mammalians that can benefit from the therapies disclosed herein. Exemplary human patients can be male and/or female.

"Patient in need thereof" or "subject in need thereof" is referred to herein as a patient diagnosed with, at risk or having, predetermined to have, or suspected of having a disease or disorder.

The terms "pathogenic mutation," "pathogenic variant," "disease casing mutation," "disease causing variant," "deleterious mutation," or "predisposing mutation" refers to a genetic alteration or mutation that increases an individual's susceptibility or predisposition to a certain disease or disorder. In some embodiments, the pathogenic mutation comprises at least one wild-type amino acid substituted by at least one pathogenic amino acid in a protein encoded by a gene.

The term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). The terms such as "excipient," "carrier," "pharmaceutically acceptable carrier," "vehicle," or the like are used interchangeably herein.

The term "pharmaceutical composition" means a composition formulated for pharmaceutical use.

The terms "protein," "peptide," "polypeptide," and their grammatical equivalents are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide can refer to an individual protein or a collection of proteins. One or more of the amino acids in a protein, peptide, or polypeptide can be modified, for example, by the addition of a chemical entity such as a carbohydrate group, a hydroxyl group, a phosphate group, a farnesyl group, an isofarnesyl group, a fatty acid group, a linker for conjugation, functionalization, or other modifications, etc. A protein, peptide, or polypeptide can also be a single molecule or can be a multi-molecular complex. A protein, peptide, or polypeptide can be just a fragment of a naturally occurring protein or peptide. A protein, peptide, or polypeptide can be naturally occurring, recombinant, or synthetic, or any combination thereof. The term "fusion protein" as used herein refers to a hybrid polypeptide which comprises protein domains from at least two different proteins. One protein can be located at the amino-terminal (N-terminal) portion of the fusion protein or at the carboxy-terminal (C-terminal) protein thus forming an amino-terminal fusion protein or a carboxy-terminal fusion protein, respectively. A protein can comprise different domains, for example, a nucleic acid binding domain (e.g., the gRNA binding domain of Cas9 that directs the binding of the protein to a target site) and a nucleic acid cleavage domain, or a catalytic domain of a nucleic acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA or DNA. Any of the proteins provided herein can be produced by any method known in the art. For example, the proteins provided herein can be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

Polypeptides and proteins disclosed herein (including functional portions and functional variants thereof) can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbornane)-carboxylic acid, α,γ-diaminobutyric acid, α,β-diaminopropionic acid, homophenylalanine, and α-tert-butylglycine. The polypeptides and proteins can be associated with post-translational modifications of one or more amino acids of the polypeptide constructs. Non-limiting examples of post-translational modifications include phosphorylation, acylation including acetylation and formylation, glycosylation (including N-linked and O-linked), amidation, hydroxylation, alkylation including methylation and ethylation, ubiquitylation, addition of pyrrolidone carboxylic acid, formation of disulfide bridges, sulfation, myristoylation, palmitoylation, isoprenylation, farnesylation, geranylation, glypiation, lipoylation and iodination.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, the reference is a wild-type or healthy cell. In other embodiments and without limitation, a reference is an untreated cell that is not subjected to a test condition, or is subjected to placebo or normal saline, medium, buffer, and/or a control vector that does not harbor a polynucleotide of interest.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, at least about 25 amino acids, about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, about 100 nucleotides or about 300 nucleotides or any integer thereabout or therebetween. In some embodiments, a reference sequence is a wild-type sequence of a protein of interest. In other embodiments, a reference sequence is a polynucleotide sequence encoding a wild-type protein.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA).

In some embodiments, the RNA-programmable nuclease is the (CRISPR-associated system) Cas9 endonuclease, for example, Cas9 (Casnl) from *Streptococcus pyogenes* (see, e.g., "Complete genome sequence of an M1 strain of *Streptococcus pyogenes*." Ferretti J. J., et al., Proc. Natl. Acad. Sci. U.S.A. 98:4658-4663(2001); "CRISPR RNA maturation by trans-encoded small RNA and host factor RNase III." Deltcheva E., et al., Nature 471:602-607(2011).

Because RNA-programmable nucleases (e.g., Cas9) use RNA: DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. Science 339, 819-823 (2013); Mali, P. et al., RNA-guided human genome engineering via Cas9. Science 339, 823-826 (2013); Hwang, W. Y. et al., Efficient genome editing in zebrafish using a CRISPR-Cas system. Nature biotechnology 31, 227-229 (2013); Jinek, M. et ah, RNA-programmed genome editing in human cells. eLife 2, e00471 (2013); Dicarlo, J. E. et al., Genome engineering in *Saccharomyces cerevisiae* using CRISPR-Cas systems. Nucleic acids research (2013); Jiang, W. et al., RNA-guided editing of bacterial genomes using CRISPR-Cas systems. Nature biotechnology 31, 233-239 (2013); the entire contents of each of which are incorporated herein by reference).

The term "single nucleotide polymorphism (SNP)" is a variation in a single nucleotide that occurs at a specific position in the genome, where each variation is present to some appreciable degree within a population (e.g., >1%). For example, at a specific base position in the human genome, the C nucleotide can appear in most individuals, but in a minority of individuals, the position is occupied by an A. This means that there is a SNP at this specific position, and the two possible nucleotide variations, C or A, are said to be alleles for this position. SNPs underlie differences in susceptibility to disease. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs. Synonymous SNPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation can also be called a single-nucleotide alteration.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the invention, but which does not substantially recognize and bind other molecules in a sample, for example, a biological sample.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a one: embodiment, hybridization will occur at 30° C. in 750 mM NaCl, 75 mM trisodium citrate, and 1% SDS. In another embodiment, hybridization will occur at 37° C. in 500 mM NaCl, 50 mM trisodium citrate, 1% SDS, 35% formamide, and 100 μg/ml denatured salmon sperm DNA (ssDNA). In another embodiment, hybridization will occur at 42° C. in 250 mM NaCl, 25 mM trisodium citrate, 1% SDS, 50% formamide, and 200 μg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "split" is meant divided into two or more fragments.

A "split Cas9 protein" or "split Cas9" refers to a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a "reconstituted" Cas9 protein. In particular embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351:867-871. PDB file: 5F9R, each of which is incorporated herein by reference. In some embodiments, the protein is divided into two fragments at any C, T, A, or S within a region of SpCas9 between about amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, S469, or C574. In some embodiments, the process of dividing the protein into two fragments is referred to as "splitting" the protein.

In other embodiments, the N-terminal portion of the Cas9 protein comprises amino acids 1-573 or 1-637 *S. pyogenes* Cas9 wild-type (SpCas9) (NCBI Reference Sequence: NC_002737.2, Uniprot Reference Sequence: Q99ZW2) and the C-terminal portion of the Cas9 protein comprises a portion of amino acids 574-1368 or 638-1368 of SpCas9 wild-type.

The C-terminal portion of the split Cas9 can be joined with the N-terminal portion of the split Cas9 to form a complete Cas9 protein. In some embodiments, the C-terminal portion of the Cas9 protein starts from where the N-terminal portion of the Cas9 protein ends. As such, in some embodiments, the C-terminal portion of the split Cas9 comprises a portion of amino acids (551-651)-1368 of spCas9. "(551-651)-1368" means starting at an amino acid between amino acids 551-651 (inclusive) and ending at amino acid 1368. For example, the C-terminal portion of the split Cas9 may comprise a portion of any one of amino acid 551-1368, 552-1368, 553-1368, 554-1368, 555-1368, 556-1368, 557-1368, 558-1368, 559-1368, 560-1368, 561-1368, 562-1368, 563-1368, 564-1368, 565-1368, 566-1368, 567-1368, 568-1368, 569-1368, 570-1368, 571-1368, 572-1368, 573-1368, 574-1368, 575-1368, 576-1368, 577-1368, 578-1368, 579-1368, 580-1368, 581-1368, 582-1368, 583-1368, 584-1368, 585-1368, 586-1368, 587-1368, 588-1368, 589-1368, 590-1368, 591-1368, 592-1368, 593-1368, 594-1368, 595-1368, 596-1368, 597-1368, 598-1368, 599-1368, 600-1368, 601-1368, 602-1368, 603-1368, 604-1368, 605-1368, 606-1368, 607-1368, 608-1368, 609-1368, 610-1368, 611-1368, 612-1368, 613-1368, 614-1368, 615-1368, 616-1368, 617-1368, 618-1368, 619-1368, 620-1368, 621-1368, 622-1368, 623-1368, 624-1368, 625-1368, 626-1368, 627-1368, 628-1368, 629-1368, 630-1368, 631-1368, 632-1368, 633-1368, 634-1368, 635-1368, 636-1368, 637-1368, 638-1368, 639-1368, 640-1368, 641-1368, 642-1368, 643-1368, 644-1368, 645-1368, 646-1368, 647-1368, 648-1368, 649-1368, 650-1368, or 651-1368 of spCas9. In some embodiments, the C-terminal portion of the split Cas9 protein comprises a portion of amino acids 574-1368 or 638-1368 of SpCas9.

By "subject" is meant a mammal, including, but not limited to, a human or non-human mammal, such as a bovine, equine, canine, ovine, or feline. Subjects include livestock, domesticated animals raised to produce labor and to provide commodities, such as food, including without limitation, cattle, goats, chickens, horses, pigs, rabbits, and sheep.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). In one embodiment, such a sequence is at least 60%, 80% or 85%, 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

COBALT is used, for example, with the following parameters:

a) alignment parameters: Gap penalties-11,-1 and End-Gap penalties-5,-1, b) CDD Parameters: Use RPS BLAST on; Blast E-value 0.003; Find Conserved columns and Recompute on, and c) Query Clustering Parameters: Use query clusters on; Word Size 4; Max cluster distance 0.8; Alphabet Regular.

EMBOSS Needle is used, for example, with the following parameters:

a) Matrix: BLOSUM62;

b) GAP OPEN: 10;

c) GAP EXTEND: 0.5;

d) OUTPUT FORMAT: pair;

e) END GAP PENALTY: """"false"""".

f) END GAP OPEN: 10; and g) END GAP EXTEND: 0.5.

The term "target site" refers to a sequence within a nucleic acid molecule that is modified by a nucleobase editor. In one embodiment, the target site is deaminated by a deaminase or a fusion protein comprising a deaminase (e.g., cytidine or adenine deaminase).

As used herein, the terms "treat," treating," "treatment," and the like refer to reducing or ameliorating a disorder and/or symptoms associated therewith or obtaining a desired pharmacologic and/or physiologic effect. It will be appreciated that, although not precluded, treating a disorder or condition does not require that the disorder, condition or symptoms associated therewith be completely eliminated. In some embodiments, the effect is therapeutic, i.e., without limitation, the effect partially or completely reduces, diminishes, abrogates, abates, alleviates, decreases the intensity of, or cures a disease and/or adverse symptom attributable to the disease. In some embodiments, the effect is preventative, i.e., the effect protects or prevents an occurrence or reoccurrence of a disease or condition. To this end, the presently disclosed methods comprise administering a therapeutically effective amount of a compositions as described herein.

By "uracil glycosylase inhibitor" or "UGI" is meant an agent that inhibits the uracil-excision repair system. In one embodiment, the agent is a protein or fragment thereof that binds a host uracil-DNA glycosylase and prevents removal of uracil residues from DNA. In an embodiment, a UGI is a protein, a fragment thereof, or a domain that is capable of inhibiting a uracil-DNA glycosylase base-excision repair enzyme. In some embodiments, a UGI domain comprises a wild-type UGI or a modified version thereof. In some embodiments, a UGI domain comprises a fragment of the exemplary amino acid sequence set forth below. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or 100% of the exemplary UGI sequence provided below. In some embodiments, a UGI comprises an amino acid sequence that is homologous to the exemplary UGI amino acid sequence or fragment thereof, as set forth below. In some embodiments, the UGI, or a portion thereof, is at least 70%, at least 75%, at least 80%, at least 85%, at least 90%, at least 95%, at least 96%, at least 97%, at least 98%, at least 99%, at least 99.5%, at least 99.9%, or 100% identical to a wild-type UGI or a UGI sequence, or portion thereof, as set forth below. An exemplary UGI comprises an amino acid sequence as follows:

>splP14739IUNGI_BPPB2 Uracil-DNA Glycosylase Inhibitor (SEQ ID NO: 224)

MTNLSDIIEKETGKQLVIQESILMLPEEVEEVIGNKPESDILVHTAYDE
STDENVMLLTSDAPEYKPWALVIQDSNGENKIKML.

The term "vector" refers to a means of introducing a nucleic acid sequence into a cell, resulting in a transformed cell. Vectors include plasmids, transposons, phages, viruses, liposomes, and episome. "Expression vectors" are nucleic acid sequences comprising the nucleotide sequence to be expressed in the recipient cell. Expression vectors may include additional nucleic acid sequences to promote and/or facilitate the expression of the of the introduced sequence such as start, stop, enhancer, promoter, and secretion sequences.

Any compositions or methods provided herein can be combined with one or more of any of the other compositions and methods provided herein.

DNA editing has emerged as a viable means to modify disease states by correcting pathogenic mutations at the genetic level. Until recently, all DNA editing platforms have functioned by inducing a DNA double strand break (DSB) at a specified genomic site and relying on endogenous DNA repair pathways to determine the product outcome in a semi-stochastic manner, resulting in complex populations of genetic products. Though precise, user-defined repair outcomes can be achieved through the homology directed repair (HDR) pathway, a number of challenges have prevented high efficiency repair using HDR in therapeutically-relevant cell types. In practice, this pathway is inefficient relative to the competing, error-prone non-homologous end joining pathway. Further, HDR is tightly restricted to the G1 and S phases of the cell cycle, preventing precise repair of DSBs in post-mitotic cells. As a result, it has proven difficult or impossible to alter genomic sequences in a user-defined, programmable manner with high efficiencies in these populations.

BRIEF DESCRIPTION OF THE DRAWINGS

FIG. 1A are schematics depicting an experimental design of a cis-trans assay for SpCas9 and deaminases in a base editor complex or untethered format. FIG. 1B is a graph depicting cis-trans activity of rAPOBEC. FIG. 1C is a graph depicting cis-trans activity of TadA7.10 and TadA-TadA7.10.

FIG. 2A is a schematic depicting an experimental design of a cis-trans assay. Separate plasmids encoding SaCas9, gRNA for SaCas9 and target base editors were used to transfect HEK293T cells. FIG. 2B is a schematic depicting a similarity network of APOBEC-like deaminases. Dots represent cytidine deaminases screened as next-generation CBEs and indicate core next-generation CBEs. The shade of the dots represent average in trans/in cis ratio; the size of the dots represent average in cis activity. Methods of creating the similarity network of cytidine deaminases shown in FIG. 2B are as follows: To focus the search space within the APOBEC1-like protein family, human APOBEC1 was used as a query sequence for a protein BLAST search against the NCBI non-redundant protein sequences database (nr_v5). The top 1000 sequences were used to generate a sequence similarity network (SSN) with a protein BLAST-log (E-value) edge-threshold of 115. A set of 43 deaminases was selected to sample the sequence space within the SSN. To identify deaminases from other families that could act as base-editing enzymes, 80 sequences from a SSN built from all deaminases was sampled with the following InterPro annotations IPR002125 (Cytidine and deoxycytidylate deaminase domain), IPR016192 (APOBEC/CMP deaminase, zinc-binding), and IPR016193 (Cytidine deaminase-like). This set of 82,043 sequences was first clustered at 55% identity using Cd-HIT[3] before generating a SSN network by protein BLAST with a −log (E-value) edge-threshold of 50. Sequences were chosen based on their centrality within a cluster of sequence in the network. FIG. 2C is aS graph depicting cis-trans activity of ppBE4 and its mutants. FIG. 2D is a graph depicting cis-trans activity of selected editors. Separately, cis-trans-activity data was generated based on in cis/in trans assay on three target sites, site 1, site 4, and site 6, as shown in FIG. 2E and FIG. 2F. FIG. 2E presents a bar graph showing in cis and in trans editing activity of identified CBEs. Shown is a comparison of in cis and in trans editing frequencies of mammalian cells treated with candidate CBEs. Editor numbers 1-36 are base editors pYY-BEM3.8, pYY-BEM3.9, pYY-BEM3.10, pYY-BEM3.11, pYY-BEM3.12, pYY-BEM3.13, pYY-BEM3.14, pYY-BEM3.15, pYY-BEM3.16, pYY-BEM3.17, pYY-BEM3.18, pYY-BEM3.19, pYY- BEM3.20, pYY-BEM3.21, pYY-BEM3.22, pYY-BEM3.23, pYY-BEM3.24, pYY-BEM3.25, pYY-BEM3.26, pYY-BEM3.27, pYY-BEM3.28, pYY-BEM3.29, pYY-BEM3.30, pYY-BEM3.31, pYY-BEM3.32, pYY-BEM3.33, pYY-BEM3.34, pYY-BEM3.35, pYY-BEM3.36, pYY-BEM3.37, pYY-BEM3.38, pYY-BEM3.39, pYY-BEM3.40, pYY-BEM3.41, pYY-BEM3.42, pYY-BEM3.43, respectively. Base editing efficiencies were reported for the most edited base in the target sites. FIG. 2F presents a bar graph showing in cis and in trans editing activity of identified CBEs. Shown is a comparison of in cis and in trans editing frequencies of mammalian cells treated with candidate CBEs. Editor numbers 1-37 are rBE4max, mAPOBEC-1, MaAPOBEC-1, hAPOBEC-1, ppAPOBEC-1, OcAPOBEC1, MdAPOBEC-1, mAPOBEC-2, hAPOBEC-2, ppAPOBEC-2, BtAPOBEC-2, mAPOBEC-3, hAPOBEC-3A, hAPOBEC-3B, hAPOBEC-3C, hAPOBEC-3D, hAPOBEC-3F, hAPOBEC-3G, hAPOBEC-4, mAPOBEC-4, rAPOBEC-4, MfAPOBEC-4, hAID, negative control, btAID, mAID, pmCDA-1, pmCDA-2, pmCDA-5, yCD, pYY-BEM3.1, pYY-BEM3.2, pYY-BEM3.3, pYY-BEM3.4, pYY-BEM3.5, pYY-BEM3.6, pYY-BEM3.7, respectively. Base editing efficiencies were reported for the most edited base in the target sites.

FIG. 3A is a graph depicting cis-trans activity of ABE7.10. FIG. 3B is a graph depicting cis-trans activity of BE4max.

FIG. 4A is a schematic depicting mutations that potentially affect ssDNA binding. FIG. 4B is a schematic depicting mutations that potentially affect catalytic activity.

FIGS. 5A-5C depict cis-trans activity of rAPOBEC1 mutants.

FIG. 6A are graphs depicting in cis and in trans activity of rAPOBEC1 double mutants. FIG. 6B is a graph depicting in cis activities at 6 sites. FIG. 6C is a graph depicting cis/trans ratio. FIG. 6D is a graph depicting in cis activities at 6 sites. FIG. 6E is a graph depicting cis/trans ratio.

FIG. 7B discloses SEQ ID NOS 442-454, 454-461, 459, 462-463, 463-465, 463, 459 and 463, respectively, in order of appearance.

FIGS. 15A-15E depict editing windows of selected editors.

FIG. 17A illustrates potential ssDNA formation in the genome during transcription or translation. FIG. 17B illustrates an experimental design of in cis/in trans assay. Separate constructs encoding SaCas9, gRNA for SaCas9 and base editor were used to transfect HEK293T cells. in cis and in trans activity was measured in different transfections but at the target site with NGGRRT PAM sequence. FIG. 17C shows in cis/in trans activities of BE4 with rAPOBEC1. FIG. 17D shows ABE7.10 variant at 34 genomic sites. The leftmost bars at each of the genomic sites on the x-axis indicate in cis, on target editing. The rightmost bars at each of the genomic sites on the x-axis indicate in trans editing. Base editing efficiencies were reported for the most-edited base in the target sites. Values and error bars reflect the mean and standard deviation (s.d.) of independent biological duplicates.

FIG. 19A shows whole transcriptome sequencing and target RNA sequencing (FIG. 19B) of Hek293T cells expressing spurious deamination minimized cytosine base editors. FIG. 19C shows the percentage of C to T editing at known guided off-target sites. FIG. 19D shows the percentage of C to T editing in in vitro enzymatic assay on single strand DNA substrates. C to U editing of core next-generation CBEs on ssDNA substrates. Dots represent NC local sequence context of edit. Black line indicates average editing efficiency across target cytosines in substrates. FIG. 19E presents a time course of product formation in in vitro enzymatic assay from cell lysates containing selected CBEs. The sequences of the oligos used in FIGS. 19D and 19E are listed in the table presented in Example 5 infra. Values and error bars reflect the mean and s.d. of independent biological triplicates (FIGS. 19A, B, C) or duplicates (FIGS. 19D, E).

FIGS. 22A and 22B show a graph and sequence alignments related to in cis/in trans editing activities and sequence alignment of CBEs tested in the $1^{st}$ round screening. in cis/in trans editing activities at site 10 (FIG. 22A) and sequence alignment (FIG. 22B) of selected CBEs (SEQ ID NOS 466-471, 468, 472-478, 468, 479-481, 468, 482, 480, 483, 468, 484, 470, 483, 468, 485-495, 492, 496-510, 507-508, 511-516, 513, 517-522, 516, 523, 517, 524-531, 528-530, 532-534, 520, 535, 533-534, 520, 535, 518, 536, 520, 537-545, 538-539, 544, 541, 538-539, 544, 541 and 546-549, respectively, in order of appearance). The amino acid residues that align to HiFi mutations in rAPOBEC1 are highlighted. Values and error bars reflect the mean and s.d. of independent biological duplicates.

FIG. 25 presents an editing window of CBEs shown in FIG. 18B at 10 target sites. Values reflect the mean of four independent biological replicates. In cis and in trans editing are presented in the leftmost and rightmost panel heatmaps, respectively.

FIG. 27A: Homology model of PpAPOBEC1 is based on based on a putative APOBEC3G structure (PDB ID 5K81). FIG. 27B: RrA3F is based on Vif-binding Domain of hAPOBEC3F (PDB ID 3WUS). FIG. 27C: AmAPOBEC1 is based on a hAPOBEC3B N-terminal domain (PDB ID 5TKM). FIG. 27D: SsAPOBEC2 is based on Vif-binding Domain of hAPOBEC3F (PDB ID 3WUS).

FIG. 28A: Editing efficiency of next generation CBEs on HEK2, HEK3, HEK4 sites, and FIG. 28B: reported guided off-target sites for HEK2 sgRNA, FIG. 28C, HEK3 sgRNA and FIG. 28D: HEK4 sgRNA. Base editing efficiencies were reported for the most-edited base in the target sites. Values and error bars reflect the mean and s.d. of independent biological triplicates.

DETAILED DESCRIPTION OF THE EMBODIMENTS

Figure 1A:
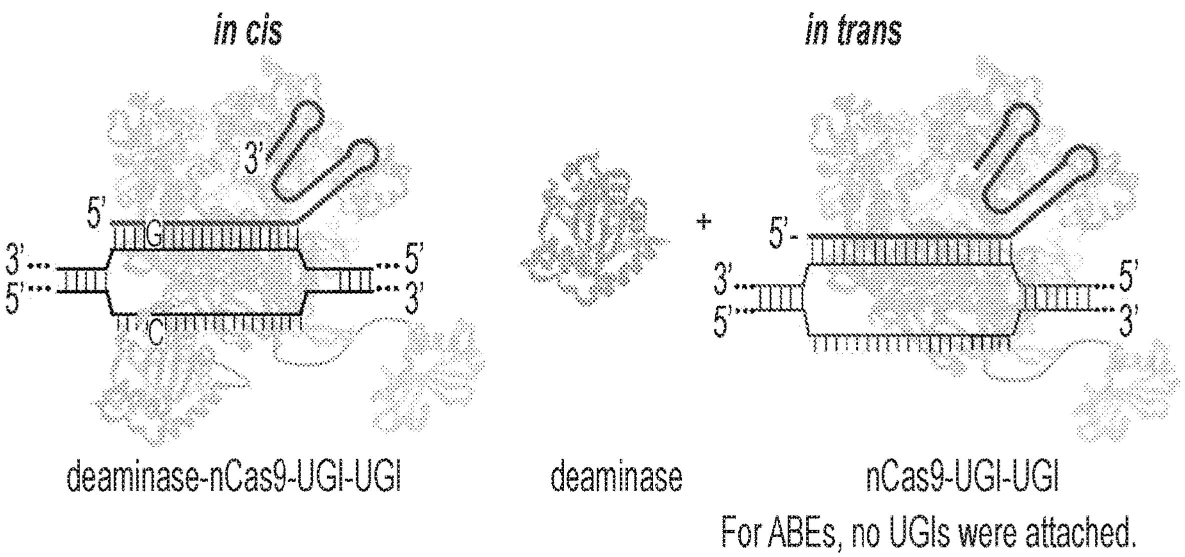
FIGS. 1A-1C depict cis-trans activity of free deaminases.

The invention provides nucleobase editors and multi-effector nucleobase editors having an improved editing profile with minimal off-target deamination, compositions comprising such editors, and methods of using the same to generate modifications in target nucleobase sequences.

Nucleobase Editors

Disclosed herein is a base editor or a nucleobase editor or multi-effector nucleobase editors for editing, modifying or altering a target nucleotide sequence of a polynucleotide. Described herein is a nucleobase editor or a base editor or multi-effector nucleobase editor comprising a polynucleotide programmable nucleotide binding domain (e.g., Cas9) and at least one nucleobase editing domain (e.g., adenosine deaminase and/or cytidine deaminase). A polynucleotide programmable nucleotide binding domain (e.g., Cas9), when in conjunction with a bound guide polynucleotide (e.g., gRNA), can specifically bind to a target polynucleotide sequence (i.e., via complementary base pairing between bases of the bound guide nucleic acid and bases of the target polynucleotide sequence) and thereby localize the base editor to the target nucleic acid sequence desired to be edited.

Polynucleotide Programmable Nucleotide Binding Domain

It should be appreciated that polynucleotide programmable nucleotide binding domains can also include nucleic acid programmable proteins that bind RNA. For example, the polynucleotide programmable nucleotide binding domain can be associated with a nucleic acid that guides the polynucleotide programmable nucleotide binding domain to an RNA. Other nucleic acid programmable DNA binding proteins are also within the scope of this disclosure, though they are not specifically listed in this disclosure.

A polynucleotide programmable nucleotide binding domain of a base editor can itself comprise one or more domains. For example, a polynucleotide programmable nucleotide binding domain can comprise one or more nuclease domains. In some embodiments, the nuclease domain of a polynucleotide programmable nucleotide binding domain can comprise an endonuclease or an exonuclease. Herein the term "exonuclease" refers to a protein or polypeptide capable of digesting a nucleic acid (e.g., RNA or DNA) from free ends, and the term "endonuclease" refers to a protein or polypeptide capable of catalyzing (e.g., cleaving) internal regions in a nucleic acid (e.g., DNA or RNA). In some embodiments, an endonuclease can cleave a single strand of a double-stranded nucleic acid. In some embodiments, an endonuclease can cleave both strands of a double-stranded nucleic acid molecule. In some embodiments a polynucleotide programmable nucleotide binding domain can be a deoxyribonuclease. In some embodiments a polynucleotide programmable nucleotide binding domain can be a ribonuclease.

In some embodiments, a nuclease domain of a polynucleotide programmable nucleotide binding domain can cut zero, one, or two strands of a target polynucleotide. In some embodiments, the polynucleotide programmable nucleotide binding domain can comprise a nickase domain. Herein the term "nickase" refers to a polynucleotide programmable nucleotide binding domain comprising a nuclease domain that is capable of cleaving only one strand of the two strands in a duplexed nucleic acid molecule (e.g., DNA). In some embodiments, a nickase can be derived from a fully catalytically active (e.g., natural) form of a polynucleotide programmable nucleotide binding domain by introducing one or more mutations into the active polynucleotide programmable nucleotide binding domain. For example, where a polynucleotide programmable nucleotide binding domain comprises a nickase domain derived from Cas9, the Cas9-derived nickase domain can include a D10A mutation and a histidine at position 840. In such embodiments, the residue H840 retains catalytic activity and can thereby cleave a single strand of the nucleic acid duplex. In another example, a Cas9-derived nickase domain can comprise an H840A mutation, while the amino acid residue at position 10 remains a D. In some embodiments, a nickase can be derived from a fully catalytically active (e.g., natural) form of a polynucleotide programmable nucleotide binding domain by removing all or a portion of a nuclease domain that is not required for the nickase activity. For example, where a polynucleotide programmable nucleotide binding domain comprises a nickase domain derived from Cas9, the Cas9-derived nickase domain can comprise a deletion of all or a portion of the RuvC domain or the HNH domain.

The amino acid sequence of an exemplary catalytically active Cas9 is as follows:

```
MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD.
```

A base editor comprising a polynucleotide programmable nucleotide binding domain comprising a nickase domain is thus able to generate a single-strand DNA break (nick) at a specific polynucleotide target sequence (e.g., determined by the complementary sequence of a bound guide nucleic acid). In some embodiments, the strand of a nucleic acid duplex target polynucleotide sequence that is cleaved by a base editor comprising a nickase domain (e.g., Cas9-derived nickase domain) is the strand that is not edited by the base editor (i.e., the strand that is cleaved by the base editor is opposite to a strand comprising a base to be edited). In other embodiments, a base editor comprising a nickase domain (e.g., Cas9-derived nickase domain) can cleave the strand of a DNA molecule which is being targeted for editing. In such embodiments, the non-targeted strand is not cleaved.

Also provided herein are base editors comprising a polynucleotide programmable nucleotide binding domain which is catalytically dead (i.e., incapable of cleaving a target polynucleotide sequence). Herein the terms "catalytically dead" and "nuclease dead" are used interchangeably to refer to a polynucleotide programmable nucleotide binding domain which has one or more mutations and/or deletions resulting in its inability to cleave a strand of a nucleic acid. In some embodiments, a catalytically dead polynucleotide programmable nucleotide binding domain base editor can lack nuclease activity as a result of specific point mutations in one or more nuclease domains. For example, in the case of a base editor comprising a Cas9 domain, the Cas9 can comprise both a D10A mutation and an H840A mutation. Such mutations inactivate both nuclease domains, thereby resulting in the loss of nuclease activity. In other embodiments, a catalytically dead polynucleotide programmable nucleotide binding domain can comprise one or more deletions of all or a portion of a catalytic domain (e.g., RuvC1 and/or HNH domains). In further embodiments, a catalytically dead polynucleotide programmable nucleotide binding domain comprises a point mutation (e.g., D10A or H840A) as well as a deletion of all or a portion of a nuclease domain.

Also contemplated herein are mutations capable of generating a catalytically dead polynucleotide programmable nucleotide binding domain from a previously functional version of the polynucleotide programmable nucleotide binding domain. For example, in the case of catalytically dead Cas9 ("dCas9"), variants having mutations other than D10A and H840A are provided, which result in nuclease inactivated Cas9. Such mutations, by way of example, include other amino acid substitutions at D10 and H840, or other substitutions within the nuclease domains of Cas9 (e.g., substitutions in the HNH nuclease subdomain and/or the RuvC1 subdomain). Additional suitable nuclease-inactive dCas9 domains can be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31 (9): 833-838, the entire contents of which are incorporated herein by reference).

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN). In some embodiments, a base editor comprises a polynucleotide programmable nucleotide binding domain comprising a natural or modified protein or portion thereof which via a bound guide nucleic acid is capable of binding to a nucleic acid sequence during CRISPR (i.e., Clustered Regularly Interspaced Short Palindromic Repeats)-mediated modification of a nucleic acid. Such a protein is referred to herein as a "CRISPR protein." Accordingly, disclosed herein is a base editor comprising a polynucleotide programmable nucleotide binding domain comprising all or a portion of a CRISPR protein (i.e. a base editor comprising as a domain all or a portion of a CRISPR protein, also referred to as a "CRISPR protein-derived domain" of the base editor). A CRISPR protein-derived domain incorporated into a base editor can be modified compared to a wild-type or natural version of the CRISPR protein. For example, as described below a CRISPR protein-derived domain can comprise one or more mutations, insertions, deletions, rearrangements and/or recombinations relative to a wild-type or natural version of the CRISPR protein.

CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems, correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, and then trimmed 3'-5' exonucleolytically. In nature, DNA-binding and cleavage typically requires protein and both RNAs. However, single guide RNAs ("sgRNA," or simply "gNRA") can be engineered so as to incorporate aspects of both the crRNA and tracrRNA into a single RNA species. See, e.g., Jinek M., et al., Science 337:816-821 (2012), the entire contents of which is hereby incorporated by reference. Cas9 recognizes a short motif in the CRISPR repeat sequences (the PAM or protospacer adjacent motif) to help distinguish self versus non-self.

In some embodiments, the methods described herein can utilize an engineered Cas protein. A guide RNA (gRNA) is a short synthetic RNA composed of a scaffold sequence necessary for Cas-binding and a user-defined ~20 nucleotide spacer that defines the genomic target to be modified. Thus, a skilled artisan can change the genomic target of the Cas protein specificity is partially determined by how specific the gRNA targeting sequence is for the genomic target compared to the rest of the genome.

In some embodiments, the gRNA scaffold sequence is as follows: GUUUUAGAGC UAGAAAUAGC AAGUUAAAAU AAGGCUAGUC CGUUAUCAAC UUGAAAAAGU GGCACCGAGU CGGUGCUUUU (SEQ ID NO: 226).

In some embodiments, a CRISPR protein-derived domain incorporated into a base editor is an endonuclease (e.g., deoxyribonuclease or ribonuclease) capable of binding a target polynucleotide when in conjunction with a bound guide nucleic acid. In some embodiments, a CRISPR protein-derived domain incorporated into a base editor is a nickase capable of binding a target polynucleotide when in conjunction with a bound guide nucleic acid. In some embodiments, a CRISPR protein-derived domain incorporated into a base editor is a catalytically dead domain capable of binding a target polynucleotide when in conjunction with a bound guide nucleic acid. In some embodiments, a target polynucleotide bound by a CRISPR protein derived domain of a base editor is DNA. In some embodiments, a target polynucleotide bound by a CRISPR protein-derived domain of a base editor is RNA.

Cas proteins that can be used herein include class 1 and class 2. Non-limiting examples of Cas proteins include Cas1, Cas1B, Cas2, Cas3, Cas4, Cas5, Cas5d, Cas5t, Cas5h, Cas5a, Cas6, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, Cas12a/Cpf1, Cas12b/C2c1, Cas12c/C2c3, Cas12d/CasY, Cas12e/CasX, Cas12g, Cas12h, and Cas12i, CARF, DinG, homologues thereof, or modified versions thereof. An unmodified CRISPR enzyme can have DNA cleavage activity, such as Cas9, which has two functional endonuclease domains: RuvC and HNH. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence.

A vector that encodes a CRISPR enzyme that is mutated to with respect, to a corresponding wild-type enzyme such that the mutated CRISPR enzyme lacks the ability to cleave one or both strands of a target polynucleotide containing a target sequence can be used. Cas9 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild-type exemplary Cas9 polypeptide (e.g., Cas9 from *S. pyogenes*). Cas9 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild-type exemplary Cas9 polypeptide (e.g., from *S. pyogenes*). Cas9 can refer to the wild-type or a modified form of the Cas9 protein that can comprise an amino acid change such as a deletion, insertion, substitution, variant, mutation, fusion, chimera, or any combination thereof.

In some embodiments, a CRISPR protein-derived domain of a base editor can include all or a portion of Cas9 from *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); *Neisseria meningitidis* (NCBI Ref: YP_002342100.1), *Streptococcus pyogenes*, or *Staphylococcus aureus*.

Cas9 Domains of Nucleobase Editors

Cas9 nuclease sequences and structures are well known to those of skill in the art (See, e.g., "Complete genome sequence of an M1 strain of *Streptococcus pyogenes*." Ferretti et al., Proc. Natl. Acad. Sci. U.S.A. 98:4658-4663 (2001); "CRISPR RNA maturation by trans-encoded small RNA and host factor RNase III." Deltcheva E., et al., Nature 471:602-607(2011); and "A programmable dual-RNA-guided DNA endonuclease in adaptive bacterial immunity."

Jinek M., et al., Science 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

In some embodiments, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain (dCas9), or a Cas9 nickase (nCas9). In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, Cas12b/C2C1, and Cas12c/C2C3.

In some embodiments, wild-type Cas9 corresponds to Cas9 from *Streptococcus pyogenes* (NCBI Reference Sequence: NC_017053.1, nucleotide and amino acid sequences as follows).

(SEQ ID NO: 179)

```
ATGGATAAGAAATACTCAATAGGCTTAGATATCGGCACAAATAGCGTCGGATGGGCGGTGAT

CACTGATGATTATAAGGTTCCGTCTAAAAAGTTCAAGGTTCTGGGAAATACAGACCGCCACA

GTATCAAAAAAAATCTTATAGGGGCTCTTTTATTTGGCAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGCAGATTC
```

-continued

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAATCTACAATCAATTATTTGAAGAAAACCCTATTAACGCAAGTAGAGTAGA

TGCTAAAGCGATTCTTTCTGCACGATTGAGTAAATCAAGACGATTAGAAAATCTCATTGCTC

AGCTCCCCGGTGAGAAGAGAAATGGCTTGTTTGGGAATCTCATTGCTTTGTCATTGGGATTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATAGT

GAAATAACTAAGGCTCCCCTATCAGCTTCAATGATTAAGCGCTACGATGAACATCATCAAGA

CTTGACTCTTTTAAAAGCTTTAGTTCGACAACAACTTCCAGAAAAGTATAAAGAAATCTTTT

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAGGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGCGCCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGGGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGATATTCAAAAAGCACAGGTGTCTGGACAAGGCCATAGTTTACATGAACAGA

TTGCTAACTTAGCTGGCAGTCCTGCTATTAAAAAAGGTATTTTACAGACTGTAAAAATTGTT

GATGAACTGGTCAAAGTAATGGGGCATAAGCCAGAAAATATCGTTATTGAAATGGCACGTGA

AAATCAGACAACTCAAAAGGGCCAGAAAAATTCGCGAGAGCGTATGAAACGAATCGAAGAAG

GTATCAAAGAATTAGGAAGTCAGATTCTTAAAGAGCATCCTGTTGAAAATACTCAATTGCAA

AATGAAAAGCTCTATCTCTATTATCTACAAAATGGAAGAGACATGTATGTGGACCAAGAATT

AGATATTAATCGTTTAAGTGATTATGATGTCGATCACATTGTTCCACAAAGTTTCATTAAAG

ACGATTCAATAGACAATAAGGTACTAACGCGTTCTGATAAAAATCGTGGTAAATCGGATAAC

GTTCCAAGTGAAGAAGTAGTCAAAAAGATGAAAAACTATTGGAGACAACTTCTAAACGCCAA

GTTAATCACTCAACGTAAGTTTGATAATTTAACGAAAGCTGAACGTGGAGGTTTGAGTGAAC

TTGATAAAGCTGGTTTTATCAAACGCCAATTGGTTGAAACTCGCCAAATCACTAAGCATGTG

GCACAAATTTTGGATAGTCGCATGAATACTAAATACGATGAAAATGATAAACTTATTCGAGA

GGTTAAAGTGATTACCTTAAAATCTAAATTAGTTTCTGACTTCCGAAAAGATTTCCAATTCT

-continued

ATAAAGTACGTGAGATTAACAATTACCATCATGCCCATGATGCGTATCTAAATGCCGTCGTT

GGAACTGCTTTGATTAAGAAATATCCAAAACTTGAATCGGAGTTTGTCTATGGTGATTATAA

AGTTTATGATGTTCGTAAAATGATTGCTAAGTCTGAGCAAGAAATAGGCAAAGCAACCGCAA

AATATTTCTTTTACTCTAATATCATGAACTTCTTCAAAACAGAAATTACACTTGCAAATGGA

GAGATTCGCAAACGCCCTCTAATCGAAACTAATGGGGAAACTGGAGAAATTGTCTGGGATAA

AGGGCGAGATTTTGCCACAGTGCGCAAAGTATTGTCCATGCCCCAAGTCAATATTGTCAAGA

AAACAGAAGTACAGACAGGCGGATTCTCCAAGGAGTCAATTTTACCAAAAAGAAATTCGGAC

AAGCTTATTGCTCGTAAAAAAGACTGGGATCCAAAAAAATATGGTGGTTTTGATAGTCCAAC

GGTAGCTTATTCAGTCCTAGTGGTTGCTAAGGTGGAAAAAGGGAAATCGAAGAAGTTAAAAT

CCGTTAAAGAGTTACTAGGGATCACAATTATGGAAAGAAGTTCCTTTGAAAAAAATCCGATT

GACTTTTTAGAAGCTAAAGGATATAAGGAAGTTAAAAAAGACTTAATCATTAAACTACCTAA

ATATAGTCTTTTTGAGTTAGAAAACGGTCGTAAACGGATGCTGGCTAGTGCCGGAGAATTAC

AAAAAGGAAATGAGCTGGCTCTGCCAAGCAAATATGTGAATTTTTTATATTTAGCTAGTCAT

TATGAAAAGTTGAAGGGTAGTCCAGAAGATAACGAACAAAAACAATTGTTTGTGGAGCAGCA

TAAGCATTATTTAGATGAGATTATTGAGCAAATCAGTGAATTTTCTAAGCGTGTTATTTTAG

CAGATGCCAATTTAGATAAAGTTCTTAGTGCATATAACAAACATAGAGACAAACCAATACGT

GAACAAGCAGAAAATATTATTCATTTATTTACGTTGACGAATCTTGGAGCTCCCGCTGCTTT

TAAATATTTTGATACAACAATTGATCGTAAACGATATACGTCTACAAAAGAAGTTTTAGATG

CCACTCTTATCCATCAATCCATCACTGGTCTTTATGAAACACGCATTGATTTGAGTCAGCTA

GGAGGTGACTGA (SEQ ID NO: 178)

MDKKYSIGLDIGTNSVGWAVITDDYKVPSKKFKVLGNTDRHSIKKNLIGALLFGSGETAEAT

RLKRTARRRYTRRKNRICYLQEIFSNEMAKVDDSFFHRLEESFLVEEDKKHERHPIFGNIVD

EVAYHEKYPTIYHLRKKLADSTDKADLRLIYLALAHMIKFRGHFLIEGDLNPDNSDVDKLFI

QLVQIYNQLFEENPINASRVDAKAILSARLSKSRRLENLIAQLPGEKRNGLFGNLIALSLGL

TPNFKSNFDLAEDAKLQLSKDTYDDDLDNLLAQIGDQYADLFLAAKNLSDAILLSDILRVNS

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGAYHDLLKIIKDKDFLDNEENEDILEDIV

LTLTLFEDRGMIEERLKTYAHLFDDKVMKQLKRRRYTGWGRLSRKLINGIRDKQSGKTILDF

LKSDGFANRNFMQLIHDDSLTFKEDIQKAQVSGQGHSLHEQIANLAGSPAIKKGILQTVKIV

DELVKVMGHKPENIVIEMARENQTTQKGQKNSRERMKRIEEGIKELGSQILKEHPVENTQLQ

NEKLYLYYLQNGRDMYVDQELDINRLSDYDVDHIVPQSFIKDDSIDNKVLTRSDKNRGKSDN

VPSEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNAVV

GTALIKKYPKLESEFVYGDYKVYDVRKMIAKSEQEIGKATAKYFFYSNIMNFFKTEITLANG

EIRKRPLIETNGETGEIVWDKGRDFATVRKVLSMPQVNIVKKTEVQTGGFSKESILPKRNSD

KLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASH

-continued
YEKLKGSPEDNEQKQLFVEQHKHYLDEIIEQISEFSKRVILADANLDKVLSAYNKHRDKPIR

EQAENIIHLFTLTNLGAPAAFKYFDTTIDRKRYTSTKEVLDATLIHQSITGLYETRIDLSQL

GGD
(single underline: HNH domain; double underline: RuvC domain)

In some embodiments, wild-type Cas9 corresponds to, or comprises the following nucleotide and/or amino acid sequences:

(SEQ ID NO: 180)
ATGGATAAAAAGTATTCTATTGGTTTAGACATCGGCACTAATTCCGTTGGATGGGCTGTCAT

AACCGATGAATACAAAGTACCTTCAAAGAAATTTAAGGTGTTGGGGAACACAGACCGTCATT

CGATTAAAAAGAATCTTATCGGTGCCCTCCTATTCGATAGTGGCGAAACGGCAGAGGCGACT

CGCCTGAAACGAACCGCTCGGAGAAGGTATACACGTCGCAAGAACCGAATATGTTACTTACA

AGAAATTTTTAGCAATGAGATGGCCAAAGTTGACGATTCTTTCTTTCACCGTTTGGAAGAGT

CCTTCCTTGTCGAAGAGGACAAGAAACATGAACGGCACCCCATCTTTGGAAACATAGTAGAT

GAGGTGGCATATCATGAAAAGTACCCAACGATTTATCACCTCAGAAAAAAGCTAGTTGACTC

AACTGATAAAGCGGACCTGAGGTTAATCTACTTGGCTCTTGCCCATATGATAAAGTTCCGTG

GGCACTTTCTCATTGAGGGTGATCTAAATCCGGACAACTCGGATGTCGACAAACTGTTCATC

CAGTTAGTACAAACCTATAATCAGTTGTTTGAAGAGAACCCTATAAATGCAAGTGGCGTGGA

TGCGAAGGCTATTCTTAGCGCCCGCCTCTCTAAATCCCGACGGCTAGAAAACCTGATCGCAC

AATTACCCGGAGAGAAGAAAAATGGGTTGTTCGGTAACCTTATAGCGCTCTCACTAGGCCTG

ACACCAAATTTTAAGTCGAACTTCGACTTAGCTGAAGATGCCAAATTGCAGCTTAGTAAGGA

CACGTACGATGACGATCTCGACAATCTACTGGCACAAATTGGAGATCAGTATGCGGACTTAT

TTTTGGCTGCCAAAAACCTTAGCGATGCAATCCTCCTATCTGACATACTGAGAGTTAATACT

GAGATTACCAAGGCGCCGTTATCCGCTTCAATGATCAAAAGGTACGATGAACATCACCAAGA

CTTGACACTTCTCAAGGCCCTAGTCCGTCAGCAACTGCCTGAGAAATATAAGGAAATATTCT

TTGATCAGTCGAAAAACGGGTACGCAGGTTATATTGACGGCGGAGCGAGTCAAGAGGAATTC

TACAAGTTTATCAAACCCATATTAGAGAAGATGGATGGGACGGAAGAGTTGCTTGTAAAACT

CAATCGCGAAGATCTACTGCGAAAGCAGCGGACTTTCGACAACGGTAGCATTCCACATCAAA

TCCACTTAGGCGAATTGCATGCTATACTTAGAAGGCAGGAGGATTTTTATCCGTTCCTCAAA

GACAATCGTGAAAAGATTGAGAAAATCCTAACCTTTCGCATACCTTACTATGTGGGACCCCT

GGCCCGAGGGAACTCTCGGTTCGCATGGATGACAAGAAAGTCCGAAGAAACGATTACTCCAT

GGAATTTTGAGGAAGTTGTCGATAAAGGTGCGTCAGCTCAATCGTTCATCGAGAGGATGACC

AACTTTGACAAGAATTTACCGAACGAAAAAGTATTGCCTAAGCACAGTTTACTTTACGAGTA

TTTCACAGTGTACAATGAACTCACGAAAGTTAAGTATGTCACTGAGGGCATGCGTAAACCCG

CCTTTCTAAGCGGAGAACAGAAGAAAGCAATAGTAGATCTGTTATTCAAGACCAACCGCAAA

GTGACAGTTAAGCAATTGAAAGAGGACTACTTTAAGAAAATTGAATGCTTCGATTCTGTCGA

GATCTCCGGGGTAGAAGATCGATTTAATGCGTCACTTGGTACGTATCATGACCTCCTAAAGA

TAATTAAAGATAAGGACTTCCTGGATAACGAAGAGAATGAAGATATCTTAGAAGATATAGTG

TTGACTCTTACCCTCTTTGAAGATCGGGAAATGATTGAGGAAAGACTAAAAACATACGCTCA

CCTGTTCGACGATAAGGTTATGAAACAGTTAAAGAGGCGTCGCTATACGGGCTGGGGACGAT

TGTCGCGGAAACTTATCAACGGGATAAGAGACAAGCAAAGTGGTAAAACTATTCTCGATTTT

-continued

CTAAAGAGCGACGGCTTCGCCAATAGGAACTTTATGCAGCTGATCCATGATGACTCTTTAAC

CTTCAAAGAGGATATACAAAAGGCACAGGTTTCCGGACAAGGGGACTCATTGCACGAACATA

TTGCGAATCTTGCTGGTTCGCCAGCCATCAAAAAGGGCATACTCCAGACAGTCAAAGTAGTG

GATGAGCTAGTTAAGGTCATGGGACGTCACAAACCGGAAAACATTGTAATCGAGATGGCACG

CGAAAATCAAACGACTCAGAAGGGGCAAAAAAACAGTCGAGAGCGGATGAAGAGAATAGAAG

AGGGTATTAAAGAACTGGGCAGCCAGATCTTAAAGGAGCATCCTGTGGAAAATACCCAATTG

CAGAACGAGAAACTTTACCTCTATTACCTACAAAATGGAAGGGACATGTATGTTGATCAGGA

ACTGGACATAAACCGTTTATCTGATTACGACGTCGATCACATTGTACCCCAATCCTTTTTGA

AGGACGATTCAATCGACAATAAAGTGCTTACACGCTCGGATAAGAACCGAGGGAAAAGTGAC

AATGTTCCAAGCGAGGAAGTCGTAAAGAAAATGAAGAACTATTGGCGGCAGCTCCTAAATGC

GAAACTGATAACGCAAAGAAAGTTCGATAACTTAACTAAAGCTGAGAGGGGTGGCTTGTCTG

AACTTGACAAGGCCGGATTTATTAAACGTCAGCTCGTGGAAACCCGCCAAATCACAAAGCAT

GTTGCACAGATACTAGATTCCCGAATGAATACGAAATACGACGAGAACGATAAGCTGATTCG

GGAAGTCAAAGTAATCACTTTAAAGTCAAAATTGGTGTCGGACTTCAGAAAGGATTTTCAAT

TCTATAAAGTTAGGGAGATAAATAACTACCACCATGCGCACGACGCTTATCTTAATGCCGTC

GTAGGGACCGCACTCATTAAGAAATACCCGAAGCTAGAAAGTGAGTTTGTGTATGGTGATTA

CAAAGTTTATGACGTCCGTAAGATGATCGCGAAAAGCGAACAGGAGATAGGCAAGGCTACAG

CCAAATACTTCTTTTATTCTAACATTATGAATTTCTTTAAGACGGAAATCACTCTGGCAAAC

GGAGAGATACGCAAACGACCTTTAATTGAAACCAATGGGGAGACAGGTGAAATCGTATGGGA

TAAGGGCCGGGACTTCGCGACGGTGAGAAAAGTTTTGTCCATGCCCCAAGTCAACATAGTAA

AGAAAACTGAGGTGCAGACCGGAGGGTTTTCAAAGGAATCGATTCTTCCAAAAAGGAATAGT

GATAAGCTCATCGCTCGTAAAAAGGACTGGGACCCGAAAAAGTACGGTGGCTTCGATAGCCC

TACAGTTGCCTATTCTGTCCTAGTAGTGGCAAAAGTTGAGAAGGGAAAATCCAAGAAACTGA

AGTCAGTCAAAGAATTATTGGGGATAACGATTATGGAGCGCTCGTCTTTTGAAAAGAACCCC

ATCGACTTCCTTGAGGCGAAAGGTTACAAGGAAGTAAAAAAGGATCTCATAATTAAACTACC

AAAGTATAGTCTGTTTGAGTTAGAAAATGGCCGAAAACGGATGTTGGCTAGCGCCGGAGAGC

TTCAAAAGGGGAACGAACTCGCACTACCGTCTAAATACGTGAATTTCCTGTATTTAGCGTCC

CATTACGAGAAGTTGAAAGGTTCACCTGAAGATAACGAACAGAAGCAACTTTTTGTTGAGCA

GCACAAACATTATCTCGACGAAATCATAGAGCAAATTTCGGAATTCAGTAAGAGAGTCATCC

TAGCTGATGCCAATCTGGACAAAGTATTAAGCGCATACAACAAGCACAGGGATAAACCCATA

CGTGAGCAGGCGGAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAG

ACGCGACACTGATTCACCAATCCATCACGGGATTATATGAAACTCGGATAGATTTGTCACAG

CTTGGGGGTGACGGATCCCCCAAGAAGAAGAGGAAAGTCTCGAGCGACTACAAAGACCATGA

CGGTGATTATAAAGATCATGACATCGATTACAAGGATGACGATGACAAGGCTGCAGGA (SEQ ID NO: 181)

MDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

-continued

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD
(single underline: HNH domain; double underline: RuvC domain).

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows):

(SEQ ID NO: 182)

ATGGATAAGAAATACTCAATAGGCTTAGATATCGGCACAAATAGCGTCGGATGGGCGGTGAT

CACTGATGAATATAAGGTTCCGTCTAAAAAGTTCAAGGTTCTGGGAAATACAGACCGCCACA

GTATCAAAAAAAATCTTATAGGGGCTCTTTTATTTGACAGTGGAGAGACAGCGGAAGCGACT

CGTCTCAAACGGACAGCTCGTAGAAGGTATACACGTCGGAAGAATCGTATTTGTTATCTACA

GGAGATTTTTTCAAATGAGATGGCGAAAGTAGATGATAGTTTCTTTCATCGACTTGAAGAGT

CTTTTTTGGTGGAAGAAGACAAGAAGCATGAACGTCATCCTATTTTTGGAAATATAGTAGAT

GAAGTTGCTTATCATGAGAAATATCCAACTATCTATCATCTGCGAAAAAAATTGGTAGATTC

TACTGATAAAGCGGATTTGCGCTTAATCTATTTGGCCTTAGCGCATATGATTAAGTTTCGTG

GTCATTTTTTGATTGAGGGAGATTTAAATCCTGATAATAGTGATGTGGACAAACTATTTATC

CAGTTGGTACAAACCTACAATCAATTATTTGAAGAAAACCCTATTAACGCAAGTGGAGTAGA

TGCTAAAGCGATTCTTTCTGCACGATTGAGTAAATCAAGACGATTAGAAAATCTCATTGCTC

AGCTCCCCGGTGAGAAGAAAAATGGCTTATTTGGGAATCTCATTGCTTTGTCATTGGGTTTG

ACCCCTAATTTTAAATCAAATTTTGATTTGGCAGAAGATGCTAAATTACAGCTTTCAAAAGA

TACTTACGATGATGATTTAGATAATTTATTGGCGCAAATTGGAGATCAATATGCTGATTTGT

TTTTGGCAGCTAAGAATTTATCAGATGCTATTTTACTTTCAGATATCCTAAGAGTAAATACT

GAAATAACTAAGGCTCCCCTATCAGCTTCAATGATTAAACGCTACGATGAACATCATCAAGA

CTTGACTCTTTTAAAAGCTTTAGTTCGACAACAACTTCCAGAAAAGTATAAAGAAATCTTTT

-continued

TTGATCAATCAAAAAACGGATATGCAGGTTATATTGATGGGGGAGCTAGCCAAGAAGAATTT

TATAAATTTATCAAACCAATTTTAGAAAAAATGGATGGTACTGAGGAATTATTGGTGAAACT

AAATCGTGAAGATTTGCTGCGCAAGCAACGGACCTTTGACAACGGCTCTATTCCCCATCAAA

TTCACTTGGGTGAGCTGCATGCTATTTTGAGAAGACAAGAAGACTTTTATCCATTTTTAAAA

GACAATCGTGAGAAGATTGAAAAAATCTTGACTTTTCGAATTCCTTATTATGTTGGTCCATT

GGCGCGTGGCAATAGTCGTTTTGCATGGATGACTCGGAAGTCTGAAGAAACAATTACCCCAT

GGAATTTTGAAGAAGTTGTCGATAAAGGTGCTTCAGCTCAATCATTTATTGAACGCATGACA

AACTTTGATAAAAATCTTCCAAATGAAAAAGTACTACCAAAACATAGTTTGCTTTATGAGTA

TTTTACGGTTTATAACGAATTGACAAAGGTCAAATATGTTACTGAAGGAATGCGAAAACCAG

CATTTCTTTCAGGTGAACAGAAGAAAGCCATTGTTGATTTACTCTTCAAAACAAATCGAAAA

GTAACCGTTAAGCAATTAAAAGAAGATTATTTCAAAAAAATAGAATGTTTTGATAGTGTTGA

AATTTCAGGAGTTGAAGATAGATTTAATGCTTCATTAGGTACCTACCATGATTTGCTAAAAA

TTATTAAAGATAAAGATTTTTTGGATAATGAAGAAAATGAAGATATCTTAGAGGATATTGTT

TTAACATTGACCTTATTTGAAGATAGGGAGATGATTGAGGAAAGACTTAAAACATATGCTCA

CCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTT

TTGAAATCAGATGGTTTTGCCAATCGCAATTTTATGCAGCTGATCCATGATGATAGTTTGAC

ATTTAAAGAAGACATTCAAAAAGCACAAGTGTCTGGACAAGGCGATAGTTTACATGAACATA

TTGCAAATTTAGCTGGTAGCCCTGCTATTAAAAAAGGTATTTTACAGACTGTAAAAGTTGTT

GATGAATTGGTCAAAGTAATGGGGCGGCATAAGCCAGAAAATATCGTTATTGAAATGGCACG

TGAAAATCAGACAACTCAAAAGGGCCAGAAAAATTCGCGAGAGCGTATGAAACGAATCGAAG

AAGGTATCAAAGAATTAGGAAGTCAGATTCTTAAAGAGCATCCTGTTGAAAATACTCAATTG

CAAAATGAAAAGCTCTATCTCTATTATCTCCAAAATGGAAGAGACATGTATGTGGACCAAGA

ATTAGATATTAATCGTTTAAGTGATTATGATGTCGATCACATTGTTCCACAAAGTTTCCTTA

AAGACGATTCAATAGACAATAAGGTCTTAACGCGTTCTGATAAAAATCGTGGTAAATCGGAT

AACGTTCCAAGTGAAGAAGTAGTCAAAAAGATGAAAAACTATTGGAGACAACTTCTAAACGC

CAAGTTAATCACTCAACGTAAGTTTGATAATTTAACGAAAGCTGAACGTGGAGGTTTGAGTG

AACTTGATAAAGCTGGTTTTATCAAACGCCAATTGGTTGAAACTCGCCAAATCACTAAGCAT

GTGGCACAAATTTTGGATAGTCGCATGAATACTAAATACGATGAAAATGATAAACTTATTCG

AGAGGTTAAAGTGATTACCTTAAAATCTAAATTAGTTTCTGACTTCCGAAAAGATTTCCAAT

TCTATAAAGTACGTGAGATTAACAATTACCATCATGCCCATGATGCGTATCTAAATGCCGTC

GTTGGAACTGCTTTGATTAAGAAATATCCAAAACTTGAATCGGAGTTTGTCTATGGTGATTA

TAAAGTTTATGATGTTCGTAAAATGATTGCTAAGTCTGAGCAAGAAATAGGCAAAGCAACCG

CAAAATATTTCTTTTACTCTAATATCATGAACTTCTTCAAAACAGAAATTACACTTGCAAAT

GGAGAGATTCGCAAACGCCCTCTAATCGAAACTAATGGGGAAACTGGAGAAATTGTCTGGGA

TAAAGGGCGAGATTTTGCCACAGTGCGCAAAGTATTGTCCATGCCCCAAGTCAATATTGTCA

AGAAAACAGAAGTACAGACAGGCGGATTCTCCAAGGAGTCAATTTTACCAAAAAGAAATTCG

GACAAGCTTATTGCTCGTAAAAAAGACTGGGATCCAAAAAAATATGGTGGTTTTGATAGTCC

AACGGTAGCTTATTCAGTCCTAGTGGTTGCTAAGGTGGAAAAAGGGAAATCGAAGAAGTTAA

AATCCGTTAAAGAGTTACTAGGGATCACAATTATGGAAAGAAGTTCCTTTGAAAAAAATCCG

ATTGACTTTTTAGAAGCTAAAGGATATAAGGAAGTTAAAAAAGACTTAATCATTAAACTACC

-continued

TAAATATAGTCTTTTTGAGTTAGAAAACGGTCGTAAACGGATGCTGGCTAGTGCCGGAGAAT

TACAAAAAGGAAATGAGCTGGCTCTGCCAAGCAAATATGTGAATTTTTTATATTTAGCTAGT

CATTATGAAAAGTTGAAGGGTAGTCCAGAAGATAACGAACAAAAACAATTGTTTGTGGAGCA

GCATAAGCATTATTTAGATGAGATTATTGAGCAAATCAGTGAATTTTCTAAGCGTGTTATTT

TAGCAGATGCCAATTTAGATAAAGTTCTTAGTGCATATAACAAACATAGAGACAAACCAATA

CGTGAACAAGCAGAAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAG

ATGCCACTCTTATCCATCAATCCATCACTGGTCTTTATGAAACACGCATTGATTTGAGTCAG

CTAGGAGGTGACTGA (SEQ ID NO: 183)

MDKKYSIGLDIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVD

EVAYHEKYPTIYHLRKKLVDSTDKADLRLIYLALAHMIKFRGHFLIEGDLNPDNSDVDKLFI

QLVQTYNQLFEENPINASGVDAKAILSARLSKSRRLENLIAQLPGEKKNGLFGNLIALSLGL

TPNFKSNFDLAEDAKLQLSKDTYDDDLDNLLAQIGDQYADLFLAAKNLSDAILLSDILRVNT

EITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLK

DNREKIEKILTFRIPYYVGPLARGNSRFAWMTRKSEETITPWNFEEVVDKGASAQSFIERMT

NFDKNLPNEKVLPKHSLLYEYFTVYNELTKVKYVTEGMRKPAFLSGEQKKAIVDLLFKTNRK

VTVKQLKEDYFKKIECFDSVEISGVEDRFNASLGTYHDLLKIIKDKDFLDNEENEDILEDIV

LTLTLFEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQTVKVV

DELVKVMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLAN

GEIRKRPLIETNGETGEIVWDKGRDFATVRKVLSMPQVNIVKKTEVQTGGFSKESILPKRNS

DKLIARKKDWDPKKYGGFDSPTVAYSVLVVAKVEKGKSKKLKSVKELLGITIMERSSFEKNP

IDFLEAKGYKEVKKDLIIKLPKYSLFELENGRKRMLASAGELQKGNELALPSKYVNFLYLAS

HYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQ

LGGD (single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124).

The amino acid sequence of an exemplary catalytically inactive Cas9 (dCas9) is as follows:

(SEQ ID NO: 184)

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

-continued

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD (see, e.g., Qi et al., "Repurposing CRISPR as an RNA-guided platform for sequence-specific control of gene expression." *Cell*. 2013; 152(5): 1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

In some embodiments, a Cas9 nuclease has an inactive (e.g., an inactivated) DNA cleavage domain, that is, the Cas9 is a nickase, referred to as an "nCas9" protein (for "nickase" Cas9). A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821 (2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science.* 337:816-821(2012); Qi et al., *Cell.* 28; 152(5):1173-83 (2013)).

In some embodiments, the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9.

In some embodiments, the dCas9 comprises the amino acid sequence of dCas9 (D10A and H840A):

(SEQ ID NO: 184)

```
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDAIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD
```

(single underline: HNH domain; double underline: RuvC domain).

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

The amino acid sequence of an exemplary catalytically Cas9 nickase (nCas9) is as follows:

(SEQ ID NO: 181)

```
MDKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRLE
ESFLVEEDKKHERHPIFGNIVDEVAYHEKYPTIYHLRKKLVDSTDKADLRL
IYLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKSN
FDLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSKN
GYAGYIDGGASQEEFYKFIKPILEKMDGTEELLVKLNREDLLRKQRTFDNG
SIPHQIHLGELHAILRRQEDFYPFLKDNREKIEKILTFRIPYYVGPLARGN
SRFAWMTRKSEETITPWNFEEVVDKGASAQSFIERMTNFDKNLPNEKVLPK
HSLLYEYFTVYNELTKVKYVTEGMRKPAFLSGEQKKAIVDLLFKTNRKVTV
KQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLS
RKLINGIRDKQSGKTILDFLKSDGFANRNFMQLIHDDSLTFKEDIQKAQVS
GQGDSLHEHIANLAGSPAIKKGILQTVKVVDELVKVMGRHKPENIVIEMAR
```

-continued

ENQTTQKGQKNSRERMKRIEEGIKELGSQILKEHPVENTQLQNEKLYLYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD

In some embodiments, Cas9 refers to a Cas9 from archaea (e.g., nanoarchaea), which constitute a domain and kingdom of single-celled prokaryotic microbes. In some embodiments, the programmable nucleotide binding protein may be a CasX or CasY protein, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, in a base editor system described herein Cas9 is replaced by CasX, or a variant of CasX. In some embodiments, in a base editor system described herein Cas9 is replaced by CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the programmable nucleotide binding protein is a naturally-occurring CasX or CasY protein. In some embodiments, the programmable nucleotide binding protein comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

An exemplary CasX ((uniprot.org/uniprot/F0NN87; uniprot.org/uniprot/F0NH53) tr|F0NN87|F0NN87_SULIHCRISPR-associatedCasx protein OS=*Sulfolobus islandicus* (strain HVE10/4) GN=SiH_0402 PE=4 SV=1) amino acid sequence is as follows:

(SEQ ID NO: 189)

MEVPLYNIFGDNYIIQVATEAENSTIYNNKVEIDDEELRNVLNLAYKIAKN

NEDAAAERRGKAKKKKGEEGETTTSNIILPLSGNDKNPWTETLKCYNFPTT

VALSEVFKNFSQVKECEEVSAPSFVKPEFYEFGRSPGMVERTRRVKLEVEP

HYLIIAAAGWVLTRLGKAKVSEGDYVGVNVFTPTRGILYSLIQNVNGIVPG

IKPETAFGLWIARKVVSSVTNPNVSVVRIYTISDAVGQNPTTINGGFSIDL

TKLLEKRYLLSERLEAIARNALSISSNMRERYIVLANYIYEYLTG SKRLE

DLLYFANRDLIMNLNSDDGKVRDLKLISAYVNGELIRGEG.

An exemplary CasX (>tr|F0NH53|F0NH53_SULIR CRISPR associated protein, Casx OS=*Sulfolobus islandicus* (strain REY15A) GN=SiRe_0771 PE=4 SV=1) amino acid sequence is as follows:

(SEQ ID NO: 227)

MEVPLYNIFGDNYIIQVATEAENSTIYNNKVEIDDEELRNVLNLAYKIAKN

NEDAAAERRGKAKKKKGEEGETTTSNIILPLSGNDKNPWTETLKCYNFPTT

VALSEVFKNFSQVKECEEVSAPSFVKPEFYKFGRSPGMVERTRRVKLEVEP

HYLIMAAAGWVLTRLGKAKVSEGDYVGVNVFTPTRGILYSLIQNVNGIVPG

IKPETAFGLWIARKVVSSVTNPNVSVVSIYTISDAVGQNPTTINGGFSIDL

TKLLEKRDLLSERLEAIARNALSISSNMRERYIVLANYIYEYLTGSKRLED

LLYFANRDLIMNLNSDDGKVRDLKLISAYVNGELIRGEG.

Deltaproteobacteria CasX (SEQ ID NO: 228)

MEKRINKIRKKLSADNATKPVSRSGPMKTLLVRVMTDDLKKRLEKRRKK

PEVMPQVISNNAANNLRMLLDDYTKMKEAILQVYWQEFKDDHVGLMCKF

AQPASKKIDQNKLKPEMDEKGNLTTAGFACSQCGQPLFVYKLEQVSEKG

KAYTNYFGRCNVAEHEKLILLAQLKPVKDSDEAVTYSLGKFGQRALDFY

SIHVTKESTHPVKPLAQIAGNRYASGPVGKALSDACMGTIASFLSKYQD

IIIEHQKVVKGNQKRLESLRELAGKENLEYPSVTLPPQPHTKEGVDEAY

NEVIARVRMWVNLNLWQKLKLSRDDAKPLLRLKGFPSFPVVERRENEVD

WWNTINEVKKLIDAKRDMGRVFWSGVTAEKRNTILEGYNYLPNENDHKK

REGSLENPKKPAKRQFGDLLLYLEKKYAGDWGKVFDEAWERIDKKIAGL

TSHIEREEARNAEDAQSKAVLTDWLRAKASFVLERLKEMDEKEFYACEI

QLQKWYGDLRGNPFAVEAENRVVDISGFSIGSDGHSIQYRNLLAWKYLE

NGKREFYLLMNYGKKGRIRFTDGTDIKKSGKWQGLLYGGGKAKVIDLTF

DPDDEQLIILPLAFGTRQGREFIWNDLLSLETGLIKLANGRVIEKTIYN

KKIGRDEPALFVALTFERREVVDPSNIKPVNLIGVARGENIPAVIALTD

PEGCPLPEFKDSSGGPTDILRIGEGYKEKQRAIQAAKEVEQRRAGGYSR

KFASKSRNLADDMVRNSARDLFYHAVTHDAVLVFANLSRGFGRQGKRTF

MTERQYTKMEDWLTAKLAYEGLTSKTYLSKTLAQYTSKTCSNCGFTITY

-continued

```
ADMDVMLVRLKKTSDGWATTLNNKELKAEYQITYYNRYKRQTVEKELSA

ELDRLSEESGNNDISKWTKGRRDEALFLLKKRFSHRPVQEQFVCLDCGH

EVHAAEQAALNIARSWLFLNSNSTEFKSYKSGKQPFVGAWQAFYKRRLK

EVWKPNA
```

An exemplary CasY ((ncbi.nlm.nih.gov/protein/APG80656.1)>APG80656.1 CRISPR-associated protein CasY (uncultured Parcubacteria group bacterium]) amino acid sequence is as follows:

```
                                            (SEQ ID NO: 229)
MSKRHPRISGVKGYRLHAQRLEYTGKSGAMRTIKYPLYSSPSGGRTVPR

EIVSAINDDYVGLYGLSNFDDLYNAEKRNEEKVYSVLDFWYDCVQYGAV

FSYTAPGLLKNVAEVRGGSYELTKTLKGSHLYDELQIDKVIKFLNKKEI

SRANGSLDKLKKDIIDCFKAEYRERHKDQCNKLADDIKNAKKDAGASLG

ERQKKLFRDFFGISEQSENDKPSFTNPLNLTCCLLPFDTVNNNRNRGEV

LFNKLKEYAQKLDKNEGSLEMWEYIGIGNSGTAFSNFLGEGFLGRLREN

KITELKKAMMDITDAWRGQEQEEELEKRLRILAALTIKLREPKFDNHWG

GYRSDINGKLSSWLQNYINQTVKIKEDLKGHKKDLKKAKEMINRFGESD

TKEEAVVSSLLESIEKIVPDDSADDEKPDIPAIAIYRRFLSDGRLTLNR

FVQREDVQEALIKERLEAEKKKKPKKRKKKSDAEDEKETIDFKELFPHL

AKPLKLVPNFYGDSKRELYKKYKNAAIYTDALWKAVEKIYKSAFSSSLK

NSFFDTDFDKDFFIKRLQKIFSVYRRFNTDKWKPIVKNSFAPYCDIVSL

AENEVLYKPKQSRSRKSAAIDKNRVRLPSTENIAKAGIALARELSVAGF

DWKDLLKKEEHEEYIDLIELHKTALALLLAVTETQLDISALDFVENGTV

KDFMKTRDGNLVLEGRFLEMFSQSIVFSELRGLAGLMSRKEFITRSAIQ

TMNGKQAELLYIPHEFQSAKITTPKEMSRAFLDLAPAEFATSLEPESLS

EKSLLKLKQMRYYPHYFGYELTRTGQGIDGGVAENALRLEKSPVKKREI

KCKQYKTLGRGQNKIVLYVRSSYYQTQFLEWFLHRPKNVQTDVAVSGSF

LIDEKKVKTRWNYDALTVALEPVSGSERVFVSQPFTIFPEKSAEEEGQR

YLGIDIGEYGIAYTALEITGDSAKILDQNFISDPQLKTLREEVKGLKLD

QRRGTFAMPSTKIARIRESLVHSLRNRIHHLALKHKAKIVYELEVSRFE

EGKQKIKKVYATLKKADVYSEIDADKNLQTTVWGKLAVASEISASYTSQ

FCGACKKLWRAEMQVDETITTQELIGTVRVIKGGTLIDAIKDFMRPPIF

DENDTPFPKYRDFCDKHHISKKMRGNSCLFICPFCRANADADIQASQTI

ALLRYVKEEKKVEDYFERFRKLKNIKVLGQMKKI.
```

The Cas9 nuclease has two functional endonuclease domains: RuvC and HNH. Cas9 undergoes a conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some embodiments, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)] (e.g., (b+c)/(a+b+c), where "a" is the band intensity of DNA substrate and "b" and "c" are the cleavage products).

In some embodiments, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2})\times 100$, where "a" is the band intensity of DNA substrate and "b" and "c" are the cleavage products (Ran et. al., Cell. 2013 Sep. 12; 154(6):1380-9; and Ran et al., Nat Protoc. 2013 November; 8(11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most embodiments, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag. In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some embodiments, Cas9 is a variant Cas9 protein. A variant Cas9 polypeptide has an amino acid sequence that is different by one amino acid (e.g., has a deletion, insertion, substitution, fusion) when compared to the amino acid sequence of a wild-type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some embodiments, the variant Cas9 protein has no substantial nuclease activity. When a subject Cas9 protein is a variant Cas9 protein that has no substantial nuclease activity, it can be referred to as "dCas9."

In some embodiments, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some embodiments, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337(6096):816-21).

In some embodiments, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some embodiments, a variant Cas9 protein has a reduced ability to cleave both the complementary and the non-complementary strands of a double stranded target DNA. As a non-limiting example, in some embodiments, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors H840A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors H840A, D10A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some embodiments, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such embodiments, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, a modified SpCas9 including amino acid substitutions D1135M, S1136Q, G1218K, E1219F, A1322R, D1332A, R1335E, and T1337R (SpCas9-MQKFRAER) and having specificity for the altered PAM 5'-NGC-3' was used.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins more similar to types I and III than from type II systems. Functional Cpf1 doesn't need the trans-activating CRISPR RNA (tracrRNA), therefore, only CRISPR (crRNA) is required. This benefits genome editing because Cpf1 is not only smaller than Cas9, but also it has a smaller sgRNA molecule (proximately half as many nucleotides as Cas9). The Cpf1-crRNA complex cleaves target DNA or RNA by identification of a protospacer adjacent motif 5'-YTN-3' in contrast to the G-rich PAM targeted by Cas9. After identification of PAM, Cpf1 introduces a sticky-end-like DNA double-stranded break of 4 or 5 nucleotides overhang.

Nucleic Acid Programmable DNA Binding Proteins

Some aspects of the disclosure provide fusion proteins comprising domains that act as nucleic acid programmable DNA binding proteins, which may be used to guide a protein, such as a base editor, to a specific nucleic acid (e.g., DNA or RNA) sequence. In particular embodiments, a fusion protein comprises a nucleic acid programmable DNA binding protein domain and one or more deaminase domains. Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" CRISPR J. 2018 October; 1:325-336. doi: 10.1089/crispr.2018.0033; Yan et al., "Functionally diverse type V CRISPR-Cas systems" Science. 2019 Jan. 4; 363(6422):88-91. doi: 10.1126/science.aav7271, the entire contents of each are hereby incorporated by reference.

One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

Useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., Cell, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A. It should be appreciated that Cpf1 from other bacterial species may also be used in accordance with the present disclosure.

Wild-type *Francisella novicida* Cpf1 (D917, E1006, and D1255 are bolded and underlined)

(SEQ ID NO: 230)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN

Francisella novicida Cpf1 D917A (A917, E1006, and D1255 are bolded and underlined)

(SEQ ID NO: 231)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

-continued

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN

*Francisella novicida* Cpf1 E1006A (D917, A1006, and D1255 are bolded and underlined)
(SEQ ID NO: 232)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN

*Francisella novicida* Cpf1 D1255A (D917, E1006, and A1255 are bolded and underlined)
(SEQ ID NO: 233)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

-continued

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN

*Francisella novicida* Cpf1 D917A/E1006A (A917, A1006, and D1255 are bolded and underlined)

(SEQ ID NO: 234)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDADANGAYHIGLKGLMLLGRIKNNQEGKKLNLVIKNEEYFEFVQNRNN

-continued

*Francisella novicida* Cpfl D917A/D1255A (A917, E1006, and A1255 are bolded and underlined)

(SEQ ID NO: 235)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFEDLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN

*Francisella novicida* Cpfl E1006A/D1255A (D917, A1006, and A1255 are bolded and underlined)

(SEQ ID NO: 236)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIDRGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

-continued

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN

*Francisella novicida* Cpf1 D917A/E1006A/D1255A (A917, A1006, and A1255 are bolded and underlined)

(SEQ ID NO: 237)

MSIYQEFVNKYSLSKTLRFELIPQGKTLENIKARGLILDDEKRAKDYKKAKQIIDKYHQFFI

EEILSSVCISEDLLQNYSDVYFKLKKSDDDNLQKDFKSAKDTIKKQISEYIKDSEKFKNLFN

QNLIDAKKGQESDLILWLKQSKDNGIELFKANSDITDIDEALEIIKSFKGWTTYFKGFHENR

KNVYSSNDIPTSIIYRIVDDNLPKFLENKAKYESLKDKAPEAINYEQIKKDLAEELTFDIDY

KTSEVNQRVFSLDEVFEIANFNNYLNQSGITKFNTIIGGKFVNGENTKRKGINEYINLYSQQ

INDKTLKKYKMSVLFKQILSDTESKSFVIDKLEDDSDVVTTMQSFYEQIAAFKTVEEKSIKE

TLSLLFDDLKAQKLDLSKIYFKNDKSLTDLSQQVFDDYSVIGTAVLEYITQQIAPKNLDNPS

KKEQELIAKKTEKAKYLSLETIKLALEEFNKHRDIDKQCRFEEILANFAAIPMIFDEIAQNK

DNLAQISIKYQNQGKKDLLQASAEDDVKAIKDLLDQTNNLLHKLKIFHISQSEDKANILDKD

EHFYLVFEECYFELANIVPLYNKIRNYITQKPYSDEKFKLNFENSTLANGWDKNKEPDNTAI

LFIKDDKYYLGVMNKKNNKIFDDKAIKENKGEGYKKIVYKLLPGANKMLPKVFFSAKSIKFY

NPSEDILRIRNHSTHTKNGSPQKGYEKFEFNIEDCRKFIDFYKQSISKHPEWKDFGFRFSDT

QRYNSIDEFYREVENQGYKLTFENISESYIDSVVNQGKLYLFQIYNKDFSAYSKGRPNLHTL

YWKALFDERNLQDVVYKLNGEAELFYRKQSIPKKITHPAKEAIANKNKDNPKKESVFEYDLI

KDKRFTEDKFFFHCPITINFKSSGANKFNDEINLLLKEKANDVHILSIARGERHLAYYTLVD

GKGNIIKQDTFNIIGNDRMKTNYHDKLAAIEKDRDSARKDWKKINNIKEMKEGYLSQVVHEI

AKLVIEYNAIVVFADLNFGFKRGRFKVEKQVYQKLEKMLIEKLNYLVFKDNEFDKTGGVLRA

YQLTAPFETFKKMGKQTGIIYYVPAGFTSKICPVTGFVNQLYPKYESVSKSQEFFSKFDKIC

YNLDKGYFEFSFDYKNFGDKAAKGKWTIASFGSRLINFRNSDKNHNWDTREVYPTKELEKLL

KDYSIEYGHGECIKAAICGESDKKFFAKLTSVLNTILQMRNSKTGTELDYLISPVADVNGNF

FDSRQAPKNMPQDAAANGAYHIGLKGLMLLGRIKNNQEGKKLNLVIKNEEYFEFVQNRNN

In some embodiments, one of the Cas9 domains present in the fusion protein may be replaced with a guide nucleotide sequence-programmable DNA-binding protein domain that has no requirements for a PAM sequence.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT or a NNGRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

Exemplary SaCas9 sequence (SEQ ID NO: 238)

KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

-continued

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEENSKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNRELIN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFYNNDLIKINGELYRV

IGVNNDLLNRIEVNMIDITYREYLENMNDKRPPRIIKTIASKTQSIKKY

STDILGNLYEVKSKKHPQIIKKG

Residue N579 above, which is underlined and in bold, may be mutated (e.g., to a A579) to yield a SaCas9 nickase.

Exemplary SaCas9n sequence
(SEQ ID NO: 239)

KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEEASKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNRELIN

DTLYSTRKDDKGNTLIVNNLNGLYDKDNDKLKKLINKSPEKLLMYHHDP

QTYQKLKLIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFYNNDLIKINGELYRV

IGVNNDLLNRIEVNMIDITYREYLENMNDKRPPRIIKTIASKTQSIKKY

STDILGNLYEVKSKKHPQIIKKG

Residue A579 above, which can be mutated from N579 to yield a SaCas9 nickase, is underlined and in bold.

Exemplary SaKKH Cas9
(SEQ ID NO: 240)

KRNYILGLDIGITSVGYGIIDYETRDVIDAGVRLFKEANVENNEGRRSK

RGARRLKRRRRHRIQRVKKLLFDYNLLTDHSELSGINPYEARVKGLSQK

LSEEEFSAALLHLAKRRGVHNVNEVEEDTGNELSTKEQISRNSKALEEK

YVAELQLERLKKDGEVRGSINRFKTSDYVKEAKQLLKVQKAYHQLDQSF

IDTYIDLLETRRTYYEGPGEGSPFGWKDIKEWYEMLMGHCTYFPEELRS

VKYAYNADLYNALNDLNNLVITRDENEKLEYYEKFQIIENVFKQKKKPT

LKQIAKEILVNEEDIKGYRVTSTGKPEFTNLKVYHDIKDITARKEIIEN

AELLDQIAKILTIYQSSEDIQEELTNLNSELTQEEIEQISNLKGYTGTH

NLSLKAINLILDELWHTNDNQIAIFNRLKLVPKKVDLSQQKEIPTTLVD

DFILSPVVKRSFIQSIKVINAIIKKYGLPNDIIIELAREKNSKDAQKMI

NEMQKRNRQTNERIEEIIRTTGKENAKYLIEKIKLHDMQEGKCLYSLEA

IPLEDLLNNPFNYEVDHIIPRSVSFDNSFNNKVLVKQEEASKKGNRTPF

QYLSSSDSKISYETFKKHILNLAKGKGRISKTKKEYLLEERDINRFSVQ

KDFINRNLVDTRYATRGLMNLLRSYFRVNNLDVKVKSINGGFTSFLRRK

WKFKKERNKGYKHHAEDALIIANADFIFKEWKKLDKAKKVMENQMFEEK

QAESMPEIETEQEYKEIFITPHQIKHIKDFKDYKYSHRVDKKPNRKLIN

DTLYSTRKDDKGNTLIVNNLNGLYDKDNDKLKKLINKSPEKLLMYHHDP

QTYQKL*K*LIMEQYGDEKNPLYKYYEETGNYLTKYSKKDNGPVIKKIKYY

GNKLNAHLDITDDYPNSRNKVVKLSLKPYRFDVYLDNGVYKFVTVKNLD

VIKKENYYEVNSKCYEEAKKLKKISNQAEFIASFYKNDLIKINGELYRV

IGVNNDLLNRIEVNMIDITYREYLENMNDKRPP*H*IIKTIASKTQSIKKY

STDILGNLYEVKSKKHPQIIKKG.

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics.

In some embodiments, the napDNAbp is a circular permutant. In the following sequences, the plain text denotes an adenosine deaminase sequence, bold sequence indicates sequence derived from Cas9, the italics sequence denotes a linker sequence, and the underlined sequence denotes a bipartite nuclear localization sequence.

CP5 (with MSP "NGC" PID and "D10A" nickase):
(SEQ ID NO: 172)*

EIGKATAKYFFYSNIMNFFKTEITLANGEIRKRPLIETNGETGEIVWDK

GRDFATVRKVLSMPQVNIVKKTEVQTGGFSKESILPKRNSDKLIARKKD

WDPKKYGGFMQPTVAYSVLVVAKVEKGKSKKLKSVKELLGITIMERSSF

EKNPIDFLEAKGYKEVKKDLIIKLPKYSLFELENGRKRMLASAKFLQKG

NELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAP

RAFKYFDTTIARKEYRSTKEVLDATLIHQSITGLYETRIDLSQLGGD*GG*

-continued

*SGGSGGSGGSGGSGGSGGM*DKKYSIGLAIGTNSVGWAVITDEYKVPSKK

FKVLGNTDRHSIKKNLIGALLFDSGETAEATRLKRTARRRYTRRKNRIC

YLQEIFSNEMAKVDDSFFHRLEESFLVEEDKKHERHPIFGNIVDEVAYH

EKYPTIYHLRKKLVDSTDKADLRLIYLALAHMIKFRGHFLIEGDLNPDN

SDVDKLFIQLVQTYNQLFEENPINASGVDAKAILSARLSKSRRLENLIA

QLPGEKKNGLFGNLIALSLGLTPNFKSNFDLAEDAKLQLSKDTYDDDLD

NLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYK

FIKPILEKMDGTEELLVKLNREDLLRKQRTFDNGSIPHQIHLGELHAIL

RRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDI

VLTLTLFEDREMIEERLKTYAHLFDDKVMKQLKRRRYTGWGRLSRKLIN

GIRDKQSGKTILDFLKSDGFANRNFMQLIHDDSLTFKEDIQKAQVSGQG

DSLHEHIANLAGSPAIKKGILQTVKVVDELVKVMGRHKPENIVIEMARE

NQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNR

GKSDNVPSEEVVKKMKNYWRQLLNAKLITQRKFDNLTKAERGGLSELDK

AGFIKRQLVETRQITKHVAQILDSRMNTKYDENDKLIREVKVITLKSKL

VSDFRKDFQFYKVREINNYHHAHDAYLNAVVGTALIKKYPKLESEFVYG

DYKVYDVRKMIAKSEQEGADKRTADGSEFESPKKKRKV

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (Cas12b/C2c1, and Cas12c/C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, Cas12b/C2c1, and Cas12c/C2c3, contain RuvC-like endonuclease domains related to Cpf1. A third system, contains an effector with two predicated HEPN RNase domains. Production of mature CRISPR RNA is tracrRNA-independent, unlike production of CRISPR RNA by Cas12b/C2c1. Cas12b/C2c1 depends on both CRISPR RNA and tracrRNA for DNA cleavage.

The crystal structure of *Alicyclobaccillus acidoterrastris* Cas12b/C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167 (7): 1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2c1 protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2c1 or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2c1 or Cas12c/C2c3 from other bacterial species may also be used in accordance with the present disclosure.

A Cas12b/C2c1 ((uniprot.org/uniprot/T0D7A2 #2) sp|T0D7A2|C2C1_ALIAG CRISPR-associated endonuclease C2c1 OS=*Alicyclobacillus* acido-*terrestris* (strain ATCC 49025/DSM 3922/CIP 106132/NCIMB 13137/GD3B) GN=c2c1 PE=1 SV=1) amino acid sequence is as follows:

MAVKSIKVKLRLDDMPEIRAGLWKLHKEVNAGVRYYTEWLSLLRQENLY

RRSPNGDGEQECDKTAEECKAELLERLRARQVENGHRGPAGSDDELLQL

ARQLYELLVPQAIGAKGDAQQIARKFLSPLADKDAVGGLGIAKAGNKPR

WVRMREAGEPGWEEEKEKAETRKSADRTADVLRALADFGLKPLMRVYTD

SEMSSVEWKPLRKGQAVRTWDRDMFQQAIERMMSWESWNQRVGQEYAKL

VEQKNRFEQKNFVGQEHLVHLVNQLQQDMKEASPGLESKEQTAHYVTGR

ALRGSDKVFEKWGKLAPDAPFDLYDAEIKNVQRRNTRRFGSHDLFAKLA

EPEYQALWREDASFLTRYAVYNSILRKLNHAKMFATFTLPDATAHPIWT

RFDKLGGNLHQYTFLFNEFGERRHAIRFHKLLKVENGVAREVDDVTVPI

SMSEQLDNLLPRDPNEPIALYFRDYGAEQHFTGEFGGAKIQCRRDQLAH

MHRRRGARDVYLNVSVRVQSQSEARGERRPPYAAVFRLVGDNHRAFVHF

DKLSDYLAEHPDDGKLGSEGLLSGLRVMSVDLGLRTSASISVFRVARKD

ELKPNSKGRVPFFFPIKGNDNLVAVHERSQLLKLPGETESKDLRAIREE

RQRTLRQLRTQLAYLRLLVRCGSEDVGRRERSWAKLIEQPVDAANHMTP

DWREAFENELQKLKSLHGICSDKEWMDAVYESVRRVWRHMGKQVRDWRK

-continued

DVRSGERPKIRGYAKDVVGGNSIEQIEYLERQYKFLKSWSFFGKVSGQV

IRAEKGSRFAITLREHIDHAKEDRLKKLADRIIMEALGYVYALDERGKG

KWVAKYPPCQLILLEELSEYQFNNDRPPSENNQLMQWSHRGVFQELINQ

AQVHDLLVGTMYAAFSSRFDARTGAPGIRCRRVPARCTQEHNPEPFPWW

LNKFVVEHTLDACPLRADDLIPTGEGEIFVSPFSAEEGDFHQIHADLNA

AQNLQQRLWSDFDISQIRLRCDWGEVDGELVLIPRLTGKRTADSYSNKV

FYTNTGVTYYERERGKKRRKVFAQEKLSEEEAELLVEADEAREKSVVLM

RDPSGIINRGNWTRQKEFWSMVNQRIEGYLVKQIRSRVPLQDSACENTG

DI.

AacCas12b (*Alicyclobacillus acidiphilus*) - WP_067623834

(SEQ ID NO: 241)

MAVKSMKVKLRLDNMPEIRAGLWKLHTEVNAGVRYYTEWLSLLRQENLY

RRSPNGDGEQECYKTAEECKAELLERLRARQVENGHCGPAGSDDELLQL

ARQLYELLVPQAIGAKGDAQQIARKFLSPLADKDAVGGLGIAKAGNKPR

WVRMREAGEPGWEEEKAKAEARKSTDRTADVLRALADFGLKPLMRVYTD

SDMSSVQWKPLRKGQAVRTWDRDMFQQAIERMMSWESWNQRVGEAYAKL

VEQKSRFEQKNFVGQEHLVQLVNQLQQDMKEASHGLESKEQTAHYLTGR

ALRGSDKVFEKWEKLDPDAPFDLYDTEIKNVQRRNTRRFGSHDLFAKLA

EPKYQALWREDASFLTRYAVYNSIVRKLNHAKMFATFTLPDATAHPIWT

RFDKLGGNLHQYTFLFNEFGEGRHAIRFQKLLTVEDGVAKEVDDVTVPI

SMSAQLDDLLPRDPHELVALYFQDYGAEQHLAGEFGGAKIQYRRDQLNH

LHARRGARDVYLNLSVRVQSQSEARGERRPPYAAVFRLVGDNHRAFVHF

DKLSDYLAEHPDDGKLGSEGLLSGLRVMSVDLGLRTSASISVFRVARKD

ELKPNSEGRVPFCFPIEGNENLVAVHERSQLLKLPGETESKDLRAIREE

RQRTLRQLRTQLAYLRLLVRCGSEDVGRRERSWAKLIEQPMDANQMTPD

WREAFEDELQKLKSLYGICGDREWTEAVYESVRRVWRHMGKQVRDWRKD

VRSGERPKIRGYQKDVVGGNSIEQIEYLERQYKFLKSWSFFGKVSGQVI

RAEKGSRFAITLREHIDHAKEDRLKKLADRIIMEALGYVYALDDERGKG

KWVAKYPPCQLILLEELSEYQFNNDRPPSENNQLMQWSHRGVFQELLNQ

AQVHDLLVGTMYAAFSSRFDARTGAPGIRCRRVPARCAREQNPEPFPWW

LNKFVAEHKLDGCPLRADDLIPTGEGEFFVSPFSAEEGDFHQIHADLNA

AQNLQRRLWSDFDISQIRLRCDWGEVDGEPVLIPRTTGKRTADSYGNKV

FYTKTGVTYYERERGKKRRKVFAQEELSEEEAELLVEADEAREKSVVLM

RDPSGIINRGDWTRQKEFWSMVNQRIEGYLVKQIRSRVRLQESACENTG

DI

BhCas12b (*Bacillus hisashii*) NCBI Reference Sequence: WP_095142515

(SEQ ID NO: 242)

MAPKKKRKVGIHGVPAAATRSFILKIEPNEEVKKGLWKTHEVLNHGIAY

YMNILKLIRQEAIYEHHEQDPKNPKKVSKAEIQAELWDFVLKMQKCNSF

THEVDKDEVFNILRELYEELVPSSVEKKGEANQLSNKFLYPLVDPNSQS

GKGTASSGRKPRWYNLKIAGDPSWEEEKKKWEEDKKKDPLAKILGKLAE

YGLIPLFIPYTDSNEPIVKEIKWMEKSRNQSVRRLDKDMFIQALERFLS

-continued

WESWNLKVKEEYEKVEKEYKTLEERIKEDIQALKALEQYEKERQEQLLR

DTLNTNEYRLSKRGLRGWREIIQKWLKMDENEPSEKYLEVFKDYQRKHP

REAGDYSVYEFLSKKENHFIWRNHPEYPYLYATFCEIDKKKKDAKQQAT

FTLADPINHPLWVRFEERSGSNLNKYRILTEQLHTEKLKKKLTVQLDRL

IYPTESGGWEEKGKVDIVLLPSRQFYNQIFLDIEEKGKHAFTYKDESIK

FPLKGTLGGARVQFDRDHLRRYPHKVESGNVGRIYFNMTVNIEPTESPV

SKSLKIHRDDFPKVVNFKPKELTEWIKDSKGKKLKSGIESLEIGLRVMS

IDLGQRQAAAASIFEVVDQKPDIEGKLFFPIKGTELYAVHRASFNIKLP

GETLVKSREVLRKAREDNLKLMNQKLNFLRNVLHFQQFEDITEREKRVT

KWISRQENSDVPLVYQDELIQIRELMYKPYKDWVAFLKQLHKRLEVEIG

KEVKHWRKSLSDGRKGLYGISLKNIDEIDRTRKFLLRWSLRPTEPGEVR

RLEPGQRFAIDQLNHLNALKEDRLKKMANTIIMHALGYCYDVRKKKWQA

KNPACQIILFEDLSNYNPYEERSRFENSKLMKWSRREIPRQVALQGEIY

GLQVGEVGAQFSSRFHAKTGSPGIRCSVVTKEKLQDNRFFKNLQREGRL

TLDKIAVLKEGDLYPDKGGEKFISLSKDRKCVTTHADINAAQNLQKRFW

TRTHGFYKVYCKAYQVDGQTVYIPESKDQKQKIIEEFGEGYFILKDGVY

EWVNAGKLKIKKGSSKQSSSELVDSDILKDSFDLASELKGEKLMLYRDP

SGNVFPSDKWMAAGVFFGKLERILISKLTNQYSISTIEDDSSKQSMKRP

AATKKAGQAKKKK

Including the variant termed BvCas12b V4 (S893R/K846R/E837G changes rel. to wt above)

BhCas12b (V4) is expressed as follows: 5' mRNA Cap - - - 5'UTR - - - bhCas12b - - - STOP sequence - - - 3'UTR - - - 120poly A tail (SEQ ID NO: 243)

5'UTR:

(SEQ ID NO: 244)

GGGAAATAAGAGAGAAAAGAAGAGTAAGAAGAAATATAAGAGCCACC

3' UTR (TriLink standard UTR)

(SEQ ID NO: 245)

GCTGGAGCCTCGGTGGCCATGCTTCTTGCCCCTTGGGCCTCCCCCCAGC

CCCTCCTCCCCTTCCTGCACCCGTACCCCCGTGGTCTTTGAATAAAGTC

TGA

Nucleic acid sequence of bhCas12b (V4)

(SEQ ID NO: 246)

ATGGCCCCAAAGAAGAAGCGGAAGGTCGGTATCCACGGAGTCCCAGCAG

CCGCCACCAGATCCTTCATCCTGAAGATCGAGCCCAACGAGGAAGTGAA

GAAAGGCCTCTGGAAAACCCACGAGGTGCTGAACCACGGAATCGCCTAC

TACATGAATATCCTGAAGCTGATCCGGCAAGAGGCCATCTACGAGCACC

ACGAGCAGGACCCCAAGAATCCCAAGAAGGTGTCCAAGGCCGAGATCCA

GGCCGAGCTGTGGGATTTCGTGCTGAAGATGCAGAAGTGCAACAGCTTC

ACACACGAGGTGGACAAGGACGAGGTGTTCAACATCCTGAGAGAGCTGT

ACGAGGAACTGGTGCCCAGCAGCGTGGAAAAGAAGGGCGAAGCCAACCA

GCTGAGCAACAAGTTTCTGTACCCTCTGGTGGACCCCAACAGCCAGTCT

GGAAAGGGAACAGCCAGCAGCGGCAGAAAGCCCAGATGGTACAACCTGA

-continued

AGATTGCCGGCGATCCCTCCTGGGAAGAAGAGAAGAAGAAGTGGGAAGA
AGATAAGAAAAAGGACCCGCTGGCCAAGATCCTGGGCAAGCTGGCTGAG
TACGGACTGATCCCTCTGTTCATCCCCTACACCGACAGCAACGAGCCCA
TCGTGAAAGAAATCAAGTGGATGGAAAAGTCCCGGAACCAGAGCGTGCG
GCGGCTGGATAAGGACATGTTCATTCAGGCCCTGGAACGGTTCCTGAGC
TGGGAGAGCTGGAACCTGAAAGTGAAAGAGGAATACGAGAAGGTCGAGA
AAGAGTACAAGACCCTGGAAGAGAGGATCAAAGAGGACATCCAGGCTCT
GAAGGCTCTGGAACAGTATGAGAAAGAGCGGCAAGAACAGCTGCTGCGG
GACACCCTGAACACCAACGAGTACCGGCTGAGCAAGAGAGGCCTTAGAG
GCTGGCGGGAAATCATCCAGAAATGGCTGAAAATGGACGAGAACGAGCC
CTCCGAGAAGTACCTGGAAGTGTTCAAGGACTACCAGCGGAAGCACCCT
AGAGAGGCCGGCGATTACAGCGTGTACGAGTTCCTGTCCAAGAAAGAGA
ACCACTTCATCTGGCGGAATCACCCTGAGTACCCCTACCTGTACGCCAC
CTTCTGCGAGATCGACAAGAAAAAGAAGGACGCCAAGCAGCAGGCCACC
TTCACACTGGCCGATCCTATCAATCACCCTCTGTGGGTCCGATTCGAGG
AAAGAAGCGGCAGCAACCTGAACAAGTACAGAATCCTGACCGAGCAGCT
GCACACCGAGAAGCTGAAGAAAAAGCTGACAGTGCAGCTGGACCGGCTG
ATCTACCCTACAGAATCTGGCGGCTGGGAAGAGAAGGGCAAAGTGGACA
TTGTGCTGCTGCCCAGCCGGCAGTTCTACAACCAGATCTTCCTGGACAT
CGAGGAAAAGGGCAAGCACGCCTTCACCTACAAGGATGAGAGCATCAAG
TTCCCTCTGAAGGGCACACTCGGCGGAGCCAGAGTGCAGTTCGACAGAG
ATCACCTGAGAAGATACCCTCACAAGGTGGAAAGCGGCAACGTGGGCAG
AATCTACTTCAACATGACCGTGAACATCGAGCCTACAGAGTCCCCAGTG
TCCAAGTCTCTGAAGATCCACCGGGACGACTTCCCCAAGGTGGTCAACT
TCAAGCCCAAAGAACTGACCGAGTGGATCAAGGACAGCAAGGGCAAGAA
ACTGAAGTCCGGCATCGAGTCCCTGGAAATCGGCCTGAGAGTGATGAGC
ATCGACCTGGGACAGAGACAGGCCGCTGCCGCCTCTATTTTCGAGGTGG
TGGATCAGAAGCCCGACATCGAAGGCAAGCTGTTTTTCCCAATCAAGGG
CACCGAGCTGTATGCCGTGCACAGAGCCAGCTTCAACATCAAGCTGCCC
GGCGAGACACTGGTCAAGAGCAGAGAAGTGCTGCGGAAGGCCAGAGAGG
ACAATCTGAAACTGATGAACCAGAAGCTCAACTTCCTGCGGAACGTGCT
GCACTTCCAGCAGTTCGAGGACATCACCGAGAGAGAGAAGCGGGTCACC
AAGTGGATCAGCAGACAAGAGAACAGCGACGTGCCCCTGGTGTACCAGG
ATGAGCTGATCCAGATCCGCGAGCTGATGTACAAGCCTTACAAGGACTG
GGTCGCCTTCCTGAAGCAGCTCCACAAGAGACTGGAAGTCGAGATCGGC
AAAGAAGTGAAGCACTGGCGGAAGTCCCTGAGCGACGGAAGAAAGGGCC
TGTACGGCATCTCCCTGAAGAACATCGACGAGATCGATCGGACCCGGAA
GTTCCTGCTGAGATGGTCCCTGAGGCCTACCGAACCTGGCGAAGTGCGT
AGACTGGAACCCGGCCAGAGATTCGCCATCGACCAGCTGAATCACCTGA
ACGCCCTGAAAGAAGATCGGCTGAAGAAGATGGCCAACACCATCATCAT

-continued

GCACGCCCTGGGCTACTGCTACGACGTGCGGAAGAAGAAATGGCAGGCT
AAGAACCCCGCCTGCCAGATCATCCTGTTCGAGGATCTGAGCAACTACA
ACCCCTACGAGGAAAGGTCCCGCTTCGAGAACAGCAAGCTCATGAAGTG
GTCCAGACGCGAGATCCCCAGACAGGTTGCACTGCAGGGCGAGATCTAT
GGCCTGCAAGTGGGAGAAGTGGGCGCTCAGTTCAGCAGCAGATTCCACG
CCAAGACAGGCAGCCCTGGCATCAGATGTAGCGTCGTGACCAAAGAGAA
GCTGCAGGACAATCGGTTCTTCAAGAATCTGCAGAGAGAGGGCAGACTG
ACCCTGGACAAAATCGCCGTGCTGAAAGAGGGCGATCTGTACCCAGACA
AAGGCGGCGAGAAGTTCATCAGCCTGAGCAAGGATCGGAAGTGCGTGAC
CACACACGCCGACATCAACGCCGCTCAGAACCTGCAGAAGCGGTTCTGG
ACAAGAACCCACGGCTTCTACAAGGTGTACTGCAAGGCCTACCAGGTGG
ACGGCCAGACCGTGTACATCCCTGAGAGCAAGGACCAGAAGCAGAAGAT
CATCGAAGAGTTCGGCGAGGGCTACTTCATTCTGAAGGACGGGGTGTAC
GAATGGGTCAACGCCGGCAAGCTGAAAATCAAGAAGGGCAGCTCCAAGC
AGAGCAGCAGCGAGCTGGTGGATAGCGACATCCTGAAAGACAGCTTCGA
CCTGGCCTCCGAGCTGAAAGGCGAAAAGCTGATGCTGTACAGGGACCCC
AGCGGCAATGTGTTCCCCAGCGACAAATGGATGGCCGCTGGCGTGTTCT
TCGGAAAGCTGGAACGCATCCTGATCAGCAAGCTGACCAACCAGTACTC
CATCAGCACCATCGAGGACGACAGCAGCAAGCAGTCTATGAAAAGGCCG
GCGGCCACGAAAAAGGCCGGCCAGGCAAAAAAGAAAAAG

In some embodiments, the Cas12b is BvCas12B, which is a variant of BhCas12b and comprises the following changes relative to BhCas12B: S893R, K846R, and E837G.

BvCas12b (*Bacillus* sp. V3-13) NCBI Reference Sequence: WP_101661451.1
(SEQ ID NO: 247)

MAIRSIKLKMKTNSGTDSIYLRKALWRTHQLINEGIAYYMNLLTLYRQE
AIGDKTKEAYQAELINIIRNQQRNNGSSEEHGSDQEILALLRQLYELII
PSSIGESGDANQLGNKFLYPLVDPNSQSGKGTSNAGRKPRWKRLKEEGN
PDWELEKKKDEERKAKDPTVKIFDNLNKYGLLPLFPLFTNIQKDIEWLP
LGKRQSVRKWDKDMFIQAIERLLSWESWNRRVADEYKQLKEKTESYYKE
HLTGGEEWIEKIRKFEKERNMELEKNAFAPNDGYFITSRQIRGWDRVYE
KWSKLPESASPEELWKVVAEQQNKMSEGFGDPKVFSFLANRENRDIWRG
HSERIYHIAAYNGLQKKLSRTKEQATFTLPDAIEHPLWIRYESPGGTNL
NLFKLEEKQKKNYYVTLSKIIWPSEEKWIEKENIEIPLAPSIQFNRQIK
LKQHVKGKQEISFSDYSSRISLDGVLGGSRIQFNRKYIKNHKELLGEGD
IGPVFFNLVVDVAPLQETRNGRLQSPIGKALKVISSDFSKVIDYKPKEL
MDWMNTGSASNSFGVASLLEGMRVMSIDMGQRTSASVSIFEVVKELPKD
QEQKLFYSINDTELFAIHKRSFLLNLPGEVVTKNNKQQRQERRKKRQFV
RSQIRMLANVLRLETKKTPDERKKAIHKLMEIVQSYDSWTASQKEVWEK
ELNLLTNMAAFNDEIWKESLVELHHRIEPYVGQIVSKWRKGLSEGRKNL
AGISMWNIDELEDTRRLLISWSKRSRTPGEANRIETDEPFGSSLLQHIQ

-continued

```
NVKDDRLKQMANLIIMTALGFKYDKEEKDRYKRWKETYPACQIILFENL

NRYLFNLDRSRRENSRLMKWAHRSIPRTVSMQGEMFGLQVGDVRSEYSS

RFHAKTGAPGIRCHALTEEDLKAGSNTLKRLIEDGFINESELAYLKKGD

IIPSQGGELFVTLSKRYKKDSDNNELTVIHADINAAQNLQKRFWQQNSE

VYRVPCQLARMGEDKLYIPKSQTETIKKYFGKGSFVKNNTEQEVYKWEK

SEKMKIKTDTTFDLQDLDGFEDISKTIELAQEQQKKYLTMFRDPSGYFF

NNETWRPQKEYWSIVNNIIKSCLKKKILSNKVEL
```

Guide Polynucleotides

In an embodiment, the guide polynucleotide is a guide RNA. An RNA/Cas complex can assist in "guiding" Cas protein to a target DNA. Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA," or simply "gNRA") can be engineered so as to incorporate aspects of both the crRNA and tracrRNA into a single RNA species. See, e.g., Jinek M. et al., Science 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see e.g., "Complete genome sequence of an M1 strain of *Streptococcus pyogenes*." Ferretti, J. J. et al., Natl. Acad. Sci. U.S.A. 98:4658-4663 (2001); "CRISPR RNA maturation by trans-encoded small RNA and host factor RNase III." Deltcheva E. et al., Nature 471:602-607(2011); and "Programmable dual-RNA-guided DNA endonuclease in adaptive bacterial immunity." Jinek M. et al, Science 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences can be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

In some embodiments, the guide polynucleotide is at least one single guide RNA ("sgRNA" or "gNRA"). In some embodiments, the guide polynucleotide is at least one tracrRNA. In some embodiments, the guide polynucleotide does not require PAM sequence to guide the polynucleotide-programmable DNA-binding domain (e.g., Cas9 or Cpf1) to the target nucleotide sequence.

The polynucleotide programmable nucleotide binding domain (e.g., a CRISPR-derived domain) of the base editors disclosed herein can recognize a target polynucleotide sequence by associating with a guide polynucleotide. A guide polynucleotide (e.g., gRNA) is typically single-stranded and can be programmed to site-specifically bind (i.e., via complementary base pairing) to a target sequence of a polynucleotide, thereby directing a base editor that is in conjunction with the guide nucleic acid to the target sequence. A guide polynucleotide can be DNA. A guide polynucleotide can be RNA. In some embodiments, the guide polynucleotide comprises natural nucleotides (e.g., adenosine). In some embodiments, the guide polynucleotide comprises non-natural (or unnatural) nucleotides (e.g., peptide nucleic acid or nucleotide analogs). In some embodiments, the targeting region of a guide nucleic acid sequence can be at least 15, 16, 17, 18, 19, 20, 21, 22, 23, 24, 25, 26, 27, 28, 29, or 30 nucleotides in length. A targeting region of a guide nucleic acid can be between 10-30 nucleotides in length, or between 15-25 nucleotides in length, or between 15-20 nucleotides in length.

In some embodiments, a guide polynucleotide comprises two or more individual polynucleotides, which can interact with one another via for example complementary base pairing (e.g., a dual guide polynucleotide). For example, a guide polynucleotide can comprise a CRISPR RNA (crRNA) and a trans-activating CRISPR RNA (tracrRNA). For example, a guide polynucleotide can comprise one or more trans-activating CRISPR RNA (tracrRNA).

In type II CRISPR systems, targeting of a nucleic acid by a CRISPR protein (e.g., Cas9) typically requires complementary base pairing between a first RNA molecule (crRNA) comprising a sequence that recognizes the target sequence and a second RNA molecule (trRNA) comprising repeat sequences which forms a scaffold region that stabilizes the guide RNA-CRISPR protein complex. Such dual guide RNA systems can be employed as a guide polynucleotide to direct the base editors disclosed herein to a target polynucleotide sequence.

In some embodiments, the base editor provided herein utilizes a single guide polynucleotide (e.g., gRNA). In some embodiments, the base editor provided herein utilizes a dual guide polynucleotide (e.g., dual gRNAs). In some embodiments, the base editor provided herein utilizes one or more guide polynucleotide (e.g., multiple gRNA). In some embodiments, a single guide polynucleotide is utilized for different base editors described herein. For example, a single guide polynucleotide can be utilized for a cytidine base editor and an adenosine base editor.

In other embodiments, a guide polynucleotide can comprise both the polynucleotide targeting portion of the nucleic acid and the scaffold portion of the nucleic acid in a single molecule (i.e., a single-molecule guide nucleic acid). For example, a single-molecule guide polynucleotide can be a single guide RNA (sgRNA or gRNA). Herein the term guide polynucleotide sequence contemplates any single, dual or multi-molecule nucleic acid capable of interacting with and directing a base editor to a target polynucleotide sequence.

Typically, a guide polynucleotide (e.g., crRNA/trRNA complex or a gRNA) comprises a "polynucleotide-targeting segment" that includes a sequence capable of recognizing and binding to a target polynucleotide sequence, and a "protein-binding segment" that stabilizes the guide polynucleotide within a polynucleotide programmable nucleotide binding domain component of a base editor. In some embodiments, the polynucleotide targeting segment of the guide polynucleotide recognizes and binds to a DNA polynucleotide, thereby facilitating the editing of a base in DNA. In other embodiments, the polynucleotide targeting segment of the guide polynucleotide recognizes and binds to an RNA polynucleotide, thereby facilitating the editing of a base in RNA. Herein a "segment" refers to a section or region of a molecule, e.g., a contiguous stretch of nucleotides in the guide polynucleotide. A segment can also refer to a region/section of a complex such that a segment can comprise regions of more than one molecule. For example, where a guide polynucleotide comprises multiple nucleic acid molecules, the protein-binding segment of can include all or a portion of multiple separate molecules that are for instance hybridized along a region of complementarity. In some embodiments, a protein-binding segment of a DNA-targeting RNA that comprises two separate molecules can comprise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and can include regions of RNA molecules that are of any total length and can include regions with complementarity to other molecules.

A guide RNA or a guide polynucleotide can comprise two or more RNAs, e.g., CRISPR RNA (crRNA) and transactivating crRNA (tracrRNA). A guide RNA or a guide polynucleotide can sometimes comprise a single-chain RNA, or single guide RNA (sgRNA) formed by fusion of a portion (e.g., a functional portion) of crRNA and tracrRNA. A guide RNA or a guide polynucleotide can also be a dual RNA comprising a crRNA and a tracrRNA. Furthermore, a crRNA can hybridize with a target DNA.

As discussed above, a guide RNA or a guide polynucleotide can be an expression product. For example, a DNA that encodes a guide RNA can be a vector comprising a sequence coding for the guide RNA. A guide RNA or a guide polynucleotide can be transferred into a cell by transfecting the cell with an isolated guide RNA or plasmid DNA comprising a sequence coding for the guide RNA and a promoter. A guide RNA or a guide polynucleotide can also be transferred into a cell in other way, such as using virus-mediated gene delivery.

A guide RNA or a guide polynucleotide can be isolated. For example, a guide RNA can be transfected in the form of an isolated RNA into a cell or organism. A guide RNA can be prepared by in vitro transcription using any in vitro transcription system known in the art. A guide RNA can be transferred to a cell in the form of isolated RNA rather than in the form of plasmid comprising encoding sequence for a guide RNA.

A guide RNA or a guide polynucleotide can comprise three regions: a first region at the 5' end that can be complementary to a target site in a chromosomal sequence, a second internal region that can form a stem loop structure, and a third 3' region that can be single-stranded. A first region of each guide RNA can also be different such that each guide RNA guides a fusion protein to a specific target site. Further, second and third regions of each guide RNA can be identical in all guide RNAs.

A first region of a guide RNA or a guide polynucleotide can be complementary to sequence at a target site in a chromosomal sequence such that the first region of the guide RNA can base pair with the target site. In some embodiments, a first region of a guide RNA can comprise from or from about 10 nucleotides to 25 nucleotides (i.e., from 10 nucleotides to nucleotides; or from about 10 nucleotides to about 25 nucleotides; or from 10 nucleotides to about 25 nucleotides; or from about 10 nucleotides to 25 nucleotides) or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more nucleotides in length. Sometimes, a first region of a guide RNA can be or can be about 19, 20, or 21 nucleotides in length.

A guide RNA or a guide polynucleotide can also comprise a second region that forms a secondary structure. For example, a secondary structure formed by a guide RNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A guide RNA or a guide polynucleotide can also comprise a third region at the 3' end that can be essentially single-stranded. For example, a third region is sometimes not complementarity to any chromosomal sequence in a cell of interest and is sometimes not complementarity to the rest of a guide RNA. Further, the length of a third region can vary. A third region can be more than or more than about 4 nucleotides in length. For example, the length of a third region can range from or from about 5 to 60 nucleotides in length.

A guide RNA or a guide polynucleotide can target any exon or intron of a gene target. In some embodiments, a guide can target exon 1 or 2 of a gene; in other embodiments, a guide can target exon 3 or 4 of a gene. A composition can comprise multiple guide RNAs that all target the same exon or in some embodiments, multiple guide RNAs that can target different exons. An exon and an intron of a gene can be targeted.

A guide RNA or a guide polynucleotide can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30, or anywhere between 1-100 nucleotides in length. A target nucleic acid can be at most or at most about 5, 10, 15, 16, 17, 18, 19, 20, 21, 22, 23, 24, 25, 30, 40, 50, or anywhere between 1-100 nucleotides in length. A target nucleic acid sequence can be or can be about 20 bases immediately 5' of the first nucleotide of the PAM. A guide RNA can target a nucleic acid sequence. A target nucleic acid can be at least or at least about 1-10, 1-20, 1-30, 1-40, 1-50, 1-60, 1-70, 1-80, 1-90, or 1-100 nucleotides.

A guide polynucleotide, for example, a guide RNA, can refer to a nucleic acid that can hybridize to another nucleic acid, for example, the target nucleic acid or protospacer in a genome of a cell. A guide polynucleotide can be RNA. A guide polynucleotide can be DNA. The guide polynucleotide can be programmed or designed to bind to a sequence of nucleic acid site-specifically. A guide polynucleotide can comprise a polynucleotide chain and can be called a single guide polynucleotide. A guide polynucleotide can comprise two polynucleotide chains and can be called a double guide polynucleotide. A guide RNA can be introduced into a cell or embryo as an RNA molecule. For example, a RNA molecule can be transcribed in vitro and/or can be chemically synthesized. An RNA can be transcribed from a synthetic DNA molecule, e.g., a gBlocks® gene fragment. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. A RNA coding sequence can be operably linked to a promoter sequence that is recognized by RNA polymerase III (Pol III). Plasmid vectors that can be used to express guide RNA include, but are not limited to, px330 vectors and px333 vectors. In some embodiments, a plasmid vector (e.g., px333 vector) can comprise at least two guide RNA-encoding DNA sequences.

Methods for selecting, designing, and validating guide polynucleotides, e.g., guide RNAs and targeting sequences are described herein and known to those skilled in the art. For example, to minimize the impact of potential substrate promiscuity of a deaminase domain in the nucleobase editor system (e.g., an AID domain), the number of residues that could unintentionally be targeted for deamination (e.g., off-target C residues that could potentially reside on ssDNA within the target nucleic acid locus) may be minimized. In addition, software tools can be used to optimize the gRNAs corresponding to a target nucleic acid sequence, e.g., to minimize total off-target activity across the genome. For example, for each possible targeting domain choice using *S. pyogenes* Cas9, all off-target sequences (preceding selected PAMs, e.g., NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g., crRNAs) can be ranked according to its total predicted off-target score; the top-ranked targeting domains represent those that are likely to have the greatest on-target and the least off-target activity. Candidate targeting gRNAs can be functionally evaluated by using methods known in the art and/or as set forth herein.

As a non-limiting example, target DNA hybridizing sequences in crRNAs of a guide RNA for use with Cas9s may be identified using a DNA sequence searching algorithm. gRNA design may be carried out using custom gRNA design software based on the public tool cas-offinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014). This software scores guides after calculating their genome-wide off-target propensity. Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a target nucleic acid sequence, e.g., a target gene may be obtained and repeat elements may be screened using publicly available tools, for example, the RepeatMasker program. RepeatMasker searches input DNA sequences for repeated elements and regions of low complexity. The output is a detailed annotation of the repeats present in a given query sequence.

Following identification, first regions of guide RNAs, e.g., crRNAs, may be ranked into tiers based on their distance to the target site, their orthogonality and presence of 5' nucleotides for close matches with relevant PAM sequences (for example, a 5' G based on identification of close matches in the human genome containing a relevant PAM e.g., NGG PAM for *S. pyogenes*, NNGRRT or NNGRRV PAM for *S. aureus*). As used herein, orthogonality refers to the number of sequences in the human genome that contain a minimum number of mismatches to the target sequence. A "high level of orthogonality" or "good orthogonality" may, for example, refer to 20-mer targeting domains that have no identical sequences in the human genome besides the intended target, nor any sequences that contain one or two mismatches in the target sequence. Targeting domains with good orthogonality may be selected to minimize off-target DNA cleavage.

In some embodiments, a reporter system may be used for detecting base-editing activity and testing candidate guide polynucleotides. In some embodiments, a reporter system may comprise a reporter gene based assay where base editing activity leads to expression of the reporter gene. For example, a reporter system may include a reporter gene comprising a deactivated start codon, e.g., a mutation on the template strand from 3'-TAC-5' to 3'-CAC-5'. Upon successful deamination of the target C, the corresponding mRNA will be transcribed as 5'-AUG-3' instead of 5'-GUG-3', enabling the translation of the reporter gene. Suitable reporter genes will be apparent to those of skill in the art. Non-limiting examples of reporter genes include gene encoding green fluorescence protein (GFP), red fluorescence protein (RFP), luciferase, secreted alkaline phosphatase (SEAP), or any other gene whose expression are detectable and apparent to those skilled in the art. The reporter system can be used to test many different gRNAs, e.g., in order to determine which residue(s) with respect to the target DNA sequence the respective deaminase will target. sgRNAs that target non-template strand can also be tested in order to assess off-target effects of a specific base editing protein, e.g., a Cas9 deaminase fusion protein. In some embodiments, such gRNAs can be designed such that the mutated start codon will not be base-paired with the gRNA. The guide polynucleotides can comprise standard ribonucleotides, modified ribonucleotides (e.g., pseudouridine), ribonucleotide isomers, and/or ribonucleotide analogs. In some embodiments, the guide polynucleotide can comprise at least one detectable label. The detectable label can be a fluorophore (e.g., FAM, TMR, Cy3, Cy5, Texas Red, Oregon Green, Alexa Fluors, Halo tags, or suitable fluorescent dye), a detection tag (e.g., biotin, digoxigenin, and the like), quantum dots, or gold particles.

The guide polynucleotides can be synthesized chemically, synthesized enzymatically, or a combination thereof. For example, the guide RNA can be synthesized using standard phosphoramidite-based solid-phase synthesis methods. Alternatively, the guide RNA can be synthesized in vitro by operably linking DNA encoding the guide RNA to a promoter control sequence that is recognized by a phage RNA polymerase. Examples of suitable phage promoter sequences include T7, T3, SP6 promoter sequences, or variations thereof. In embodiments in which the guide RNA comprises two separate molecules (e.g., crRNA and tracrRNA), the crRNA can be chemically synthesized and the tracrRNA can be enzymatically synthesized.

In some embodiments, a base editor system may comprise multiple guide polynucleotides, e.g., gRNAs. For example, the gRNAs may target to one or more target loci (e.g., at least 1 gRNA, at least 2 gRNA, at least 5 gRNA, at least 10 gRNA, at least 20 gRNA, at least 30 g RNA, at least 50 gRNA) comprised in a base editor system. The multiple gRNA sequences can be tandemly arranged and are preferably separated by a direct repeat.

A DNA sequence encoding a guide RNA or a guide polynucleotide can also be part of a vector. Further, a vector can comprise additional expression control sequences (e.g., enhancer sequences, Kozak sequences, polyadenylation sequences, transcriptional termination sequences, etc.), selectable marker sequences (e.g., GFP or antibiotic resistance genes such as puromycin), origins of replication, and the like. A DNA molecule encoding a guide RNA can also be linear. A DNA molecule encoding a guide RNA or a guide polynucleotide can also be circular.

In some embodiments, one or more components of a base editor system may be encoded by DNA sequences. Such DNA sequences may be introduced into an expression system, e.g., a cell, together or separately. For example, DNA sequences encoding a polynucleotide programmable nucleotide binding domain and a guide RNA may be introduced into a cell, each DNA sequence can be part of a separate molecule (e.g., one vector containing the polynucleotide programmable nucleotide binding domain coding sequence and a second vector containing the guide RNA coding sequence) or both can be part of a same molecule (e.g., one vector containing coding (and regulatory) sequence for both the polynucleotide programmable nucleotide binding domain and the guide RNA).

A guide polynucleotide can comprise one or more modifications to provide a nucleic acid with a new or enhanced feature. A guide polynucleotide can comprise a nucleic acid affinity tag. A guide polynucleotide can comprise synthetic nucleotide, synthetic nucleotide analog, nucleotide derivatives, and/or modified nucleotides.

In some embodiments, a gRNA or a guide polynucleotide can comprise modifications. A modification can be made at any location of a gRNA or a guide polynucleotide. More than one modification can be made to a single gRNA or a guide polynucleotide. A gRNA or a guide polynucleotide can undergo quality control after a modification. In some embodiments, quality control can include PAGE, HPLC, MS, or any combination thereof.

A modification of a gRNA or a guide polynucleotide can be a substitution, insertion, deletion, chemical modification, physical modification, stabilization, purification, or any combination thereof.

A gRNA or a guide polynucleotide can also be modified by 5' adenylate, 5' guanosine-triphosphate cap, 5'N7-Methylguanosine-triphosphate cap, 5' triphosphate cap, 3' phosphate, 3' thiophosphate, 5' phosphate, 5' thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencer 2, DABCYL SE, dT-DABCYL, IRDye QC-1, QSY-21, QSY-35, QSY-7, QSY-9, carboxyl linker, thiol linkers, 2'-deoxyribonucleoside analog purine, 2'-deoxyribonucleoside analog pyrimidine, ribonucleoside analog, 2'-O-methyl ribonucleoside analog, sugar modified analogs, wobble/universal bases, fluorescent dye label, 2'-fluoro RNA, 2'-O-methyl RNA, methylphosphonate, phosphodiester DNA, phosphodiester RNA, phosphothioate DNA, phosphorothioate RNA, UNA, pseudouridine-5'-triphosphate, 5'-methylcytidine-5'-triphosphate, or any combination thereof.

In some embodiments, a modification is permanent. In other embodiments, a modification is transient. In some embodiments, multiple modifications are made to a gRNA or a guide polynucleotide. A gRNA or a guide polynucleotide modification can alter physiochemical properties of a nucleotide, such as their conformation, polarity, hydrophobicity, chemical reactivity, base-pairing interactions, or any combination thereof.

The PAM sequence can be any PAM sequence known in the art. Suitable PAM sequences include, but are not limited to, NGG, NGA, NGC, NGN, NGT, NGCG, NGAG, NGAN, NGNG, NGCN, NGCG, NGTN, NNGRRT, NNNRRT, NNGRR (N), TTTV, TYCV, TYCV, TATV, NNNNGATT, NNAGAAW, or NAAAAC. Y is a pyrimidine; N is any nucleotide base; W is A or T.

A modification can also be a phosphorothioate substitute. In some embodiments, a natural phosphodiester bond can be susceptible to rapid degradation by cellular nucleases and; a modification of internucleotide linkage using phosphorothioate (PS) bond substitutes can be more stable towards hydrolysis by cellular degradation. A modification can increase stability in a gRNA or a guide polynucleotide. A modification can also enhance biological activity. In some embodiments, a phosphorothioate enhanced RNA gRNA can inhibit RNase A, RNase T1, calf serum nucleases, or any combinations thereof. These properties can allow the use of PS-RNA gRNAs to be used in applications where exposure to nucleases is of high probability in vivo or in vitro. For example, phosphorothioate (PS) bonds can be introduced between the last 3-5 nucleotides at the 5'- or "-end of a gRNA which can inhibit exonuclease degradation. In some embodiments, phosphorothioate bonds can be added throughout an entire gRNA to reduce attack by endonucleases.

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The PAM sequence is essential for target binding, but the exact sequence depends on a type of Cas protein.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities.

For example, typically Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length. Several PAM variants are described in Table 1 below.

TABLE 1

Cas9 proteins and corresponding PAM sequences

| Variant | PAM |
|---|---|
| spCas9 | NGG |
| spCas9-VRQR | NGA |
| spCas9-VRER | NGCG |

TABLE 1-continued

| Cas9 proteins and corresponding PAM sequences | |
|---|---|
| Variant | PAM |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| spCas9-MQKFRAER | NGC |
| Cpf1 | 5' (TTTV) |
| SpyMac | 5'-NAA-3' |

In some embodiments, the PAM is NGC. In some embodiments, the NGC PAM is recognized by a Cas9 variant. In some embodiments, the NGC PAM variant includes one or more amino acid substitutions selected from D1135M, S1136Q, G1218K, E1219F, A1322R, D1332A, R1335E, and T1337R (collectively termed "MQKFRAER").

In some embodiments, the PAM is NGT. In some embodiments, the NGT PAM is recognized by a Cas9 variant. In some embodiments, the NGT PAM variant is generated through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Table 2 and Table 3 below.

TABLE 2

| NGT PAM Variant Mutations at residues 1219, 1335, 1337, 1218 | | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |
| 24 | I | A | W | |
| 25 | I | A | F | |
| 26 | I | A | Y | |

TABLE 3

| NGT PAM Variant Mutations at residues 1135, 1136, 1218, 1219, and 1335 | | | | | |
|---|---|---|---|---|---|
| Variant | D1135L | S1136R | G1218S | E1219V | R1335Q |
| 27 | G | | | | |
| 28 | V | | | | |
| 29 | I | | | | |
| 30 | | A | | | |
| 31 | | W | | | |
| 32 | | H | | | |
| 33 | | K | | | |
| 34 | | | K | | |
| 35 | | | R | | |
| 36 | | | Q | | |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |
| 46 | | | | T | |
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

In some embodiments, the NGT PAM variant is selected from variant 5, 7, 28, 31, or 36 in Tables 2 and 3. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 4 below.

TABLE 4

| NGT PAM Variant Mutations at residues 1219, 1335, 1337, and 1218 | | | | |
|---|---|---|---|---|
| Variant | E1219V | R1335Q | T1337 | G1218 |
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, base editors with specificity for NGT PAM may be generated as provided in Table 5 below.

TABLE 5

| NGT PAM variants | | | | | | | | |
|---|---|---|---|---|---|---|---|---|
| | NGTN variant | D1135 | S1136 | G1218 | E1219 | A1322R | R1335 | T1337 |
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

In some embodiments the NGTN variant is variant 1. In some embodiments, the NGTN variant is variant 2. In some embodiments, the NGTN variant is variant 3. In some embodiments, the NGTN variant is variant 4. In some embodiments, the NGTN variant is variant 5. In some embodiments, the NGTN variant is variant 6.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1134X, a R1334X, and a T1336X mutation, or a corresponding mutation in any of the amino acid sequences provided herein, wherein X is any amino acid. In some embodiments, the SpCas9 domain comprises one or more of a D1134E, R1334Q, and T1336R mutation, or a corresponding mutation in any of the amino acid sequences provided herein. In some embodiments, the SpCas9 domain comprises a D1134E, a R1334Q, and a T1336R mutation, or corresponding mutations in any of the amino acid sequences provided herein. In some embodiments, the SpCas9 domain comprises one or more of a D1134X, a R1334X, and a T1336X mutation, or a corresponding mutation in any of the amino acid sequences provided herein, wherein X is any amino acid. In some embodiments, the SpCas9 domain comprises one or more of a D1134V, a R1334Q, and a T1336R mutation, or a corresponding mutation in any of the amino acid sequences provided herein. In some embodiments, the SpCas9 domain comprises a D1134V, a R1334Q, and a T1336R mutation, or corresponding mutations in any of the amino acid sequences provided herein. In some embodiments, the SpCas9 domain comprises one or more of a D1134X, a G1217X, a R1334X, and a T1336X mutation, or a corresponding mutation in any of the amino acid sequences provided herein, wherein X is any amino acid. In some embodiments, the SpCas9 domain comprises one or more of a D1134V, a G1217R, a R1334Q, and a T1336R mutation, or a corresponding mutation in any of the amino acid sequences provided herein. In some embodiments, the SpCas9 domain comprises a D1134V, a G1217R, a R1334Q, and a T1336R mutation, or corresponding mutations in any of the amino acid sequences provided herein.

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, *S. pyogenes* Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4 kb coding sequence) can lead to plasmids carrying the SpCas9 cDNA that cannot be efficiently expressed in a cell. Conversely, the coding sequence for *Staphylococcus aureus* Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of *S. thermophilus* (5'-NNAGAA for CRISPR1 and 5'-NGGNG for CRISPR3) and *Neisseria meningiditis* (5'-NNNNGATT) can also be found adjacent to a target gene.

In some embodiments, for a *S. pyogenes* system, a target gene sequence can precede (i.e., be 5' to) a 5'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

The amino acid sequence of an exemplary PAM-binding SpCas9 is as follows:

(SEQ ID NO: 183)

MDKKYSIGLDIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITQRKFDNLTKAERGGLSELDKAGFIKRQLVETRQITKHV
AQILDSRMNTKYDENDKLIREVKVITLKSKLVSDFRKDFQFYKVREINN
YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA
FKYFDTTIDRKRYTSTKEVLDATLIHQSITGLYETRIDLSQLGGD

The amino acid sequence of an exemplary PAM-binding SpCas9n is as follows:

(SEQ ID NO: 181)

MDKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD

-continued

KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITQRKFDNLTKAERGGLSELDKAGFIKRQLVETRQITKHV
AQILDSRMNTKYDENDKLIREVKVITLKSKLVSDFRKDFQFYKVREINN
YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA
FKYFDTTIDRKRYTSTKEVLDATLIHQSITGLYETRIDLSQLGGD

The amino acid sequence of an exemplary PAM-binding SpEQR Cas9 is as follows:

(SEQ ID NO: 248)

MDKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGTYHDLLKIIKDKDFLDNEENEDILEDIVLTLTLFEDREMIEERLK

-continued

TYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITQRKFDNLTKAERGGLSELDKAGFIKRQLVETRQITKHV
AQILDSRMNTKYDENDKLIREVKVITLKSKLVSDFRKDFQFYKVREINN
YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFESPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA
FKYFDTTIDRKQYRSTKEVLDATLIHQSITGLYETRIDLSQLGGD

In the above sequence, residues E1134, Q1334, and R1336, which can be mutated from D1134, R1334, and T1336 to yield a SpEQR Cas9, are underlined and in bold.

The amino acid sequence of an exemplary PAM-binding SpVQR Cas9 is as follows:

(SEQ ID NO: 249)

MDKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKORTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITQRKFDNLTKAERGGLSELDKAGFIKRQLVETRQITKHV
AQILDSRMNTKYDENDKLIREVKVITLKSKLVSDFRKDFQFYKVREINN

-continued

YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFVSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA
FKYFDTTIDRKQYRSTKEVLDATLIHQSITGLYETRIDLSQLGGD

In the above sequence, residues V1134, Q1334, and R1336, which can be mutated from D1134, R1334, and T1336 to yield a SpVQR Cas9, are underlined and in bold.

The amino acid sequence of an exemplary PAM-binding SpVRER Cas9 is as follows:

(SEQ ID NO: 250)

MDKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGTYHDLLKIIKDKDFLDNEENEDILEDIVLTLTLFEDREMIEERLK
TYAHLFDDKVMKOLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDHIVPQSFLKDDSIDNKVLTRSDKNRGKSDNVPSEEVVKKMKNY
WRQLLNAKLITORKFDNLTKAERGGLSELDKAGFIKRQLVETRQITKHV
AQILDSRMNTKYDENDKLIREVKVITLKSKLVSDFRKDFQFYKVREINN
YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFVSPTVAYSVLVVAKVEKGKSKKLKSVKELLGITIMERSSFEK
NPIDFLEAKGYKEVKKDLIIKLPKYSLFELENGRKRMLASARELQKGNE
LALPSKYVNFLYLASHYEKLKGSPEDNEQKOLFVEQHKHYLDEIIEQIS
EFSKRVILADANLDKVLSAYNKHRDKPIREQAENIIHLFTLTNLGAPAA
FKYFDTTIDRKEYRSTKEVLDATLIHQSITGLYETRIDLSQLGGD.

In the above sequence, residues V1134, R1217, E1334, and R1336, which can be mutated from D1134, G1217, R1334, and T1336 to yield a SpVRER Cas9, are underlined and in bold.

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a SpyMacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMacCas9 domain, the SpCas9d domain, or the SpCas9n domain can bind to a nucleic acid sequence having a NAA PAM sequence.

The sequence of an exemplary Cas9 A homolog of Spy Cas9 in *Streptococcus macacae* with native 5'-NAAN-3' PAM specificity is known in the art and described, for example, by Jakimo et al., (www.biorxiv.org/content/biorxiv/early/2018/09/27/429654.full.pdf), and is provided below.

```
SpyMacCas9
                                    (SEQ ID NO: 251)
MDKKYSIGLDIGTNSVGWAVITDDYKVPSKKFKVLGNTDRHSIKKNLIG

ALLFGSGETAEATRLKRTARRRYTRRKNRICYLQEIFSNEMAKVDDSFF

HRLEESFLVEEDKKHERHPIFGNIVDEVAYHEKYPTIYHLRKKLADSTD

KADLRLIYLALAHMIKFRGHFLIEGDLNPDNSDVDKLFIQLVQIYNQLF

EENPINASRVDAKAILSARLSKSRRLENLIAQLPGEKRNGLFGNLIALS

LGLTPNFKSNFDLAEDAKLQLSKDTYDDDLDNLLAQIGDQYADLFLAAK

NLSDAILLSDILRVNSEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGAYHDLLKIIKDKDFLDNEENEDILEDIVLTLTLFEDRGMIEERLK

TYAHLFDDKVMKQLKRRRYTGWGRLSRKLINGIRDKQSGKTILDFLKSD

GFANRNFMQLIHDDSLTFKEDIQKAQVSGQGHSLHEQIANLAGSPAIKK

GILQTVKIVDELVKVMGHKPENIVIEMARENQTTQKGQKNSRERMKRIE

EGIKELGSQILKEHPVENTQLQNEKLYLYYLQNGRDMYVDQELDINRLS

DYDVDHIVPQSFIKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEIQTVGQNGGLFDDNPKSPLEVTPSKLVPL

KKELNPKKYGGYQKPTTAYPVLLITDTKQLIPISVMNKKQFEQNPVKFL

RDRGYQQVGKNDFIKLPKYTLVDIGDGIKRLWASSKEIHKGNQLVVSKK

-continued
SQILLYHAHHLDSDLSNDYLQNHNQQFDVLFNEIISFSKKCKLGKEHIQ

KIENVYSNKKNSASIEELAESFIKLLGFTQLGATSPFNFLGVKLNQKQY

KGKKDYILPCTEGTLIRQSITGLYETRVDLSKIGED.
```

In some embodiments, a variant Cas9 protein harbors, H840A, P475A, W476A, N477A, D1125A, W1126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference.

Cas9 Domains with Reduced PAM Exclusivity

Typically, Cas9 proteins, such as Cas9 from *S. pyogenes* (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild-type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

In some embodiments, the modified Cas9 is a high fidelity Cas9 enzyme. In some embodiments, the high fidelity Cas9 enzyme is SpCas9 (K855A), eSpCas9 (1.1), SpCas9-HF1, or hyper accurate Cas9 variant (HypaCas9). The modified Cas9 eSpCas9 (1.1) contains alanine substitutions that weaken the interactions between the HNH/RuvC groove and the non-target DNA strand, preventing strand separation and cutting at off-target sites. Similarly, SpCas9-HF1 lowers off-target editing through alanine substitutions that disrupt Cas9's interactions with the DNA phosphate backbone. HypaCas9 contains mutations (SpCas9 N692A/M694A/Q695A/H698A) in the REC3 domain that increase Cas9 proofreading and target discrimination. All three high fidelity enzymes generate less off-target editing than wildtype Cas9.

An exemplary high fidelity Cas9 is provided below.

High Fidelity Cas9 domain mutations relative to Cas9 are shown in bold and underlined.

(SEQ ID NO: 252)

DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTAFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGALSRKLINGIRDKQSGKTILDFLKSDG

FANRNFMALIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRAITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD

Fusion Proteins Comprising a Cas9 Domain and a Cytidine Deaminase and/or Adenosine Deaminase Some aspects of the disclosure provide fusion proteins comprising a napDNAbp (e.g., a Cas9 domain) and one or more adenosine deaminase, cytidine deaminase domains, and/or DNA glycosylase domains. In some embodiments, the fusion protein comprises a Cas9 domain and an adenosine deaminase domain (e.g., TadA*A). It should be appreciated that the Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the cytidine deaminases and/or adenosine deaminases (e.g., TadA*A) provided herein. For example, and without limitation, in some embodiments, the fusion protein comprises the structure:

$NH_2$-[cytidine deaminase]-[Cas9 domain]-[adenosine deaminase]-COOH;
$NH_2$-[adenosine deaminase]-[Cas9 domain]-[cytidine deaminase]-COOH;
$NH_2$-[adenosine deaminase]-[cytidine deaminase]-[Cas9 domain]-COOH;
$NH_2$-[cytidine deaminase]-[adenosine deaminase]-[Cas9 domain]-COOH;
$NH_2$-[Cas9 domain]-[adenosine deaminase]-[cytidine deaminase]-COOH;
$NH_2$-[Cas9 domain]-[cytidine deaminase]-[adenosine deaminase]-COOH;
$NH_2$-[adenosine deaminase]-[Cas9 domain]-COOH;
$NH_2$-[Cas9 domain]-[adenosine deaminase]-COOH;
$NH_2$-[cytidine deaminase]-[Cas9 domain]-COOH; or
$NH_2$-[Cas9 domain]-[cytidine deaminase]-COOH.

In some embodiments, the fusion proteins comprising a cytidine deaminase, abasic editor, and adenosine deaminase and a napDNAbp (e.g., Cas9 domain) do not include a linker sequence. In some embodiments, a linker is present between the cytidine deaminase and/or adenosine deaminase domains and the napDNAbp. In some embodiments, the "-" used in the general architecture above indicates the presence of an optional linker. In some embodiments, the cytidine deaminase and adenosine deaminase and the napDNAbp are fused via any of the linkers provided herein. For example, in some embodiments the cytidine deaminase and/or adenosine deaminase and the napDNAbp are fused via any of the linkers provided herein.

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFESPKKKRKV (SEQ ID NO: 253), KRTADGSEFESPKKKRKV (SEQ ID NO: 217), KRPAATKKAGQAKKKK (SEQ ID NO: 218), KKTELQTTNAENKTKKL (SEQ ID NO: 219), KRGINDRNFWRGENGRKTR (SEQ ID NO: 220), RKSGKIAAIVVKRPRKPKKKRKV (SEQ ID NO: 254), or MDSLLMNRRKFLYQFKNVRWAKGRRETYLC (SEQ ID NO: 223).

In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite-2 parts, while monopartite NLSs are not). The NLS of nucleoplasmin, KR[PAATKKAGQA]KKKK (SEQ ID NO: 218), is the prototype of the ubiquitous bipartite signal: two clusters of basic amino acids, separated by a spacer of about 10 amino acids. The sequence of an exemplary bipartite NLS follows:

```
                                        (SEQ ID NO: 253)
PKKKRKVEGADKRTADGSEFESPKKKRKV
```

In some embodiments, the fusion proteins comprising an adenosine deaminase and/or a cytidine deaminase, a napDNAbp (e.g., a Cas9 domain), and an NLS do not comprise a linker sequence. In some embodiments, linker sequences between one or more of the domains or proteins (e.g., adenosine deaminase, cytidine deaminase, Cas9 domain or NLS) are present. In some embodiments, the general architecture of exemplary Cas9 fusion proteins with an adenosine deaminase or cytidine deaminase and a Cas9 domain comprises any one of the following structures, where NLS is a nuclear localization sequence (e.g., any NLS provided herein), $NH_2$ is the N-terminus of the fusion protein, and COOH is the C-terminus of the fusion protein:

$NH_2$-NLS-[adenosine deaminase]-[Cas9 domain]-COOH;
$NH_2$-NLS [Cas9 domain]-[adenosine deaminase]-COOH;
$NH_2$-[adenosine deaminase]-[Cas9 domain]-NLS-COOH;
$NH_2$-[Cas9 domain]-[adenosine deaminase]-NLS-COOH;
$NH_2$-NLS-[cytidine deaminase]-[Cas9 domain]-COOH;
$NH_2$-NLS [Cas9 domain]-[cytidine deaminase]-COOH;
$NH_2$-[cytidine deaminase]-[Cas9 domain]-NLS-COOH;
$NH_2$-[Cas9 domain]-[cytidine deaminase]-NLS-COOH;

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FLASH tags, V5 tags, and SBP-tags. Additional suitable sequences will be apparent to those of skill in the art. In some embodiments, the fusion protein comprises one or more His tags.

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the ammo-terminus, about or more than about 1, 2, 3, 4, 5, 6, 7, 8, 9, 10 NLSs at or near the carboxy-terminus, or any combination of these (e.g., one or more NLS at the ammo-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise about 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

Nucleobase Editing Domain

Described herein are base editors comprising a fusion protein that includes a polynucleotide programmable nucleotide binding domain and one or more nucleobase editing domains (e.g., a deaminase domain). The base editor can be programmed to edit one or more bases in a target polynucleotide sequence by interacting with a guide polynucleotide capable of recognizing the target sequence. Once the target sequence has been recognized, the base editor is anchored on the polynucleotide where editing is to occur and the deaminase domain components of the base editor can then edit a target base.

In some embodiments, the nucleobase editing domain includes one or more deaminase domains. As particularly described herein, the deaminase domain includes a cytosine deaminase and/or an adenosine deaminase. In some embodiments, the terms "cytosine deaminase" and "cytidine deaminase" can be used interchangeably. In some embodiments, the terms "adenine deaminase" and "adenosine deaminase" can be used interchangeably. Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A to G Editing

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein can comprise a Cas9 domain that has reduced nuclease activity. In some embodiments, the fusion proteins provided herein can have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, an A-to-G base editor further comprises an inhibitor of inosine base excision repair, for example, a uracil glycosylase inhibitor (UGI) domain or a catalytically inactive inosine specific nuclease. Without wishing to be bound by any particular theory, the UGI domain or catalytically inactive inosine specific nuclease can inhibit or prevent base excision repair of a deaminated adenosine residue (e.g., inosine), which can improve the activity or efficiency of the base editor.

A base editor comprising an adenosine deaminase can act on any polynucleotide, including DNA, RNA and DNA-RNA hybrids. In certain embodiments, a base editor comprising an adenosine deaminase can deaminate a target A of a polynucleotide comprising RNA. For example, the base editor can comprise an adenosine deaminase domain capable of deaminating a target A of an RNA polynucleotide and/or a DNA-RNA hybrid polynucleotide. In an embodiment, an adenosine deaminase incorporated into a base editor comprises all or a portion of adenosine deaminase acting on RNA (ADAR, e.g., ADAR1 or ADAR2). In another embodiment, an adenosine deaminase incorporated into a base editor comprises all or a portion of adenosine deaminase acting on tRNA (ADAT). A base editor comprising an adenosine deaminase domain can also be capable of deaminating an A nucleobase of a DNA polynucleotide. In an embodiment an adenosine deaminase domain of a base editor comprises all or a portion of an ADAT comprising one or more mutations which permit the ADAT to deaminate a target A in DNA. For example, the base editor can comprise all or a portion of an ADAT from *Escherichia coli* (EcTadA) comprising one or more of the following mutations: D108N, A106V, D147Y, E155V, L84F, H123Y, 1157F, or a corresponding mutation in another adenosine deaminase.

The adenosine deaminase can be derived from any suitable organism (e.g., *E. coli*). In some embodiments, the adenine deaminase is a naturally-occurring adenosine deaminase that includes one or more mutations corresponding to any of the mutations provided herein (e.g., mutations in ecTadA). The corresponding residue in any homologous protein can be identified by e.g., sequence alignment and determination of homologous residues. The mutations in any naturally-occurring adenosine deaminase (e.g., having homology to ecTadA) that corresponds to any of the mutations described herein (e.g., any of the mutations identified in ecTadA) can be generated accordingly.

Adenosine Deaminases

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the adenosine deaminases provided herein are capable of deaminating adenine. In some embodiments, the adenosine deaminases provided herein are capable of deaminating adenine in a deoxyadenosine residue of DNA. In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

The invention provides adenosine deaminase variants that have increased efficiency (>50-60%) and specificity. In particular, the adenosine deaminase variants described herein are more likely to edit a desired base within a polynucleotide, and are less likely to edit bases that are not intended to be altered (i.e., "bystanders").

In particular embodiments, the TadA is any one of the TadA described in PCT/US2017/045381 (WO 2018/027078), which is incorporated herein by reference in its entirety.

In some embodiments, the nucleobase editors of the invention are adenosine deaminase variants comprising an alteration in the following sequence:

```
                                         (SEQ ID NO: 164)
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD
(also termed TadA*7.10).
```

In some embodiments, the fusion proteins of the invention comprise as a heterodimer of a wild-type TadA (TadA(wt)) linked to a TadA variant, e.g. a TadA*7.10 variant. The relevant sequences follow:

```
Wild-type TadA (TadA(wt)) or "the TadA reference
sequence"
                                         (SEQ ID NO: 255)
MSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIHSR

IGRVVFGARDAKTGAAGSLMDVLHHPGMNHRVEITEGILADECAALLSD

FFRMRRQEIKAQKKAQSSTD

TadA*7.10:
                                         (SEQ ID NO: 164)
MSEVEFSHEYW MRHALTLAKR ARDEREVPVG AVLVLNNRVI

GEGWNRAIGL HDPTAHAEIM ALRQGGLVMQ NYRLIDATLY

VTFEPCVMCA GAMIHSRIGR VVFGVRNAKT GAAGSLMDVL

HYPGMNHRVE ITEGILADEC AALLCYFFRM PRQVFNAQKK

AQSSTD
```

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments the TadA deaminase is a full-length *E. coli* TadA deaminase. For example, in certain embodiments, the adenosine deaminase comprises the amino acid sequence:

```
                                         (SEQ ID NO: 256)
MRRAFITGVFFLSEVEFSHEYWMRHALTLAKRAWDEREVPVGAVLVHNN

RVIGEGWNRPIGRHDPTAHAEIMALRQGGLVMQNYRLIDATLYVTLEPC

VMCAGAMIHSRIGRVVFGARDAKTGAAGSLMDVLHHPGMNHRVEITEGI

LADECAALLSDFFRMRRQEIKAQKKAQSSTD.
```

It should be appreciated, however, that additional adenosine deaminases useful in the present application would be apparent to the skilled artisan and are within the scope of this disclosure. For example, the adenosine deaminase may be a homolog of adenosine deaminase acting on tRNA (ADAT). Without limitation, the amino acid sequences of exemplary AD AT homologs include the following:

```
Staphylococcus aureus TadA:
                                         (SEQ ID NO: 165)
MGSHMTNDIYFMTLAIEEAKKAAQLGEVPIGAIITKDDEVIARAHNLRE

TLQQPTAHAEHIAIERAAKVLGSWRLEGCTLYVTLEPCVMCAGTIVMSR

IPRVVYGADDPKGGCSGSLMNLLQQSNFNHRAIVDKGVLKEACSTLLTT

FFKNLRANKKSTN

Bacillus subtilis TadA:
                                         (SEQ ID NO: 166)
MTQDELYMKEAIKEAKKAEEKGEVPIGAVLVINGEIIARAHNLRETEQR

SIAHAEMLVIDEACKALGTWRLEGATLYVTLEPCPMCAGAVVLSRVEKV

VFGAFDPKGGCSGTLMNLLQEERFNHQAEVVSGVLEEECGGMLSAFFRE

LRKKKKAARKNLSE

Salmonella typhimurium (S. typhimurium) TadA:
                                         (SEQ ID NO: 167)
MPPAFITGVTSLSDVELDHEYWMRHALTLAKRAWDEREVPVGAVLVHNH

RVIGEGWNRPIGRHDPTAHAEIMALRQGGLVLQNYRLLDTTLYVTLEPC
```

-continued

VMCAGAMVHSRIGRVVFGARDAKTGAAGSLIDVLHHPGMNHRVEIIEGV

LRDECATLLSDFFRMRRQEIKALKKADRAEGAGPAV

*Shewanella putrefaciens* (*S. putrefaciens*) TadA:

(SEQ ID NO: 168)

MDEYWMQVAMQMAEKAEAAGEVPVGAVLVKDGQQIATGYNLSISQHDPT

AHAEILCLRSAGKKLENYRLLDATLYITLEPCAMCAGAMVHSRIARVVY

GARDEKTGAAGTVVNLLQHPAFNHQVEVTSGVLAEACSAQLSRFFKRRR

DEKKALKLAQRAQQGIE

*Haemophilus influenzae* F3031 (*H. influenzae*) TadA:

(SEQ ID NO: 169)

MDAAKVRSEFDEKMMRYALELADKAEALGEIPVGAVLVDDARNIIGEGW

NLSIVOSDPTAHAEIIALRNGAKNIQNYRLLNSTLYVTLEPCTMCAGAI

LHSRIKRLVFGASDYKTGAIGSRFHFFDDYKMNHTLEITSGVLAEECSQ

KLSTFFQKRREEKKIEKALLKSLSDK

*Caulobacter crescentus* (*C. crescentus*) TadA:

(SEQ ID NO: 170)

MRTDESEDQDHRMMRLALDAARAAAEAGETPVGAVILDPSTGEVIATAG

NGPIAAHDPTAHAEIAAMRAAAAKLGNYRLTDLTLVVTLEPCAMCAGAI

SHARIGRVVFGADDPKGGAVVHGPKFFAQPTCHWRPEVTGGVLADESAD

LLRGFFRARRKAKI

*Geobacter sulfurreducens* (*G. sulfurreducens*) TadA:

(SEQ ID NO: 171)

MSSLKKTPIRDDAYWMGKAIREAAKAAARDEVPIGAVIVRDGAVIGRGH

NLREGSNDPSAHAEMIAIRQAARRSANWRLTGATLYVTLEPCLMCMGAI

ILARLERVVFGCYDPKGGAAGSLYDLSADPRLNHQVRLSPGVCQEECGT

MLSDFFRDLRRRKKAKATPALFIDERKVPPEP

An embodiment of *E. Coli* TadA (ecTadA) includes the following:

(SEQ ID NO: 257)

MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD

In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

In one embodiment, a fusion protein of the invention comprises a wild-type TadA linked to TadA7.10, which is linked to Cas9 nickase. In particular embodiments, the fusion proteins comprise a single TadA7.10 domain (e.g., provided as a monomer). In other embodiments, the ABE7.10 editor comprises TadA7.10 and TadA (wt), which are capable of forming heterodimers.

It should be appreciated that any of the mutations provided herein (e.g., based on the TadA reference sequence) can be introduced into other adenosine deaminases, such as *E. coli* TadA (ecTadA), *S. aureus* TadA (saTadA), or other adenosine deaminases (e.g., bacterial adenosine deaminases). It would be apparent to the skilled artisan that additional deaminases may similarly be aligned to identify homologous amino acid residues that can be mutated as provided herein. Thus, any of the mutations identified in the TadA reference sequence can be made in other adenosine deaminases (e.g., ecTada) that have homologous amino acid residues. It should also be appreciated that any of the mutations provided herein can be made individually or in any combination in the TadA reference sequence or another adenosine deaminase.

In some embodiments, the adenosine deaminase comprises a D108X mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a D108G, D108N, D108V, D108A, or D108Y mutation, or a corresponding mutation in another adenosine deaminase.

In some embodiments, the adenosine deaminase comprises an A106X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase (e.g., wild-type TadA or ecTadA).

In some embodiments, the adenosine deaminase comprises a E155X mutation in TadA reference sequence, or a corresponding mutation in another adenosine deaminase (e.g., ecTadA), where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase (e.g., ecTadA).

In some embodiments, the adenosine deaminase comprises a D147X mutation in TadA reference sequence, or a corresponding mutation in another adenosine deaminase (e.g., ecTadA), where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase (e.g., ecTadA).

In some embodiments, the adenosine deaminase comprises an A106X, E155X, or D147X, mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E155D, E155G, or E155V mutation. In some embodiments, the adenosine deaminase comprises a D147Y.

For example, an adenosine deaminase can contain a D108N, a A106V, a E155V, and/or a D147Y mutation in TadA reference sequence, or a corresponding mutation in another adenosine deaminase (e.g., ecTadA). In some embodiments, an adenosine deaminase comprises the following group of mutations (groups of mutations are separated by a ";") in TadA reference sequence, or corresponding mutations in another adenosine deaminase (e.g., ecTadA): D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D 147Y; and D108N, A106V, E55V, and D147Y. It should be appreciated, however, that any combination of corresponding mutations provided herein can be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, 195X, V102X, F104X, A106X, R107X, D108X, K110X, M118X, N127X, A138X, F149X, M151X, R153X, Q154X, I156X, and/or K157X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, 1951, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation in TadA reference sequence, or one or more corresponding mutations in another adenosine deaminase (e.g., ecTadA).

In some embodiments, the adenosine deaminase comprises one or more of a H8X, D108X, and/or N127X mutation in TadA reference sequence, or one or more corresponding mutations in another adenosine deaminase (e.g., ecTadA), where X indicates the presence of any amino acid. In some embodiments, the adenosine deaminase comprises one or more of a H8Y, D108N, and/or N127S mutation in TadA reference sequence, or one or more corresponding mutations in another adenosine deaminase (e.g., ecTadA).

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase (e.g., ecTadA), where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in TadA reference sequence, or one or more corresponding mutations in another adenosine deaminase (e.g., ecTadA).

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase (e.g., ecTadA). In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, R126W, L68Q, D108N, N127S, D147Y, and E155V in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase (e.g., ecTadA).

Any of the mutations provided herein and any additional mutations (e.g., based on the ecTadA amino acid sequence) can be introduced into any other adenosine deaminases. Any of the mutations provided herein can be made individually or in any combination in TadA reference sequence or another adenosine deaminase (e.g., ecTadA).

Details of A to G nucleobase editing proteins are described in International PCT Application No. PCT/2017/045381 (WO2018/027078) and Gaudelli, N. M., et al., "Programmable base editing of A·T to G·C in genomic DNA without DNA cleavage" Nature, 551, 464-471 (2017), the entire contents of which are hereby incorporated by reference.

In some embodiments, the adenosine deaminase comprises one or more corresponding mutations in another adenosine deaminase (e.g., ecTadA). In some embodiments, the adenosine deaminase comprises a D108N, D108G, or D108V mutation in TadA reference sequence, or corresponding mutations in another adenosine deaminase (e.g., ecTadA). In some embodiments, the adenosine deaminase comprises a A106V and D108N mutation in TadA reference sequence, or corresponding mutations in another adenosine deaminase (e.g., ecTadA). In some embodiments, the adenosine deaminase comprises R107C and D108N mutations in TadA reference sequence, or corresponding mutations in another adenosine deaminase (e.g., ecTadA). In some embodiments, the adenosine deaminase comprises a H8Y, D108N, N127S, D147Y, and Q154H mutation in TadA reference sequence, or corresponding mutations in another adenosine deaminase (e.g., ecTadA). In some embodiments, the adenosine deaminase comprises a H8Y, R24W, D108N, N127S, D147Y, and E155V mutation in TadA reference sequence, or corresponding mutations in another adenosine deaminase (e.g., ecTadA). In some embodiments, the adenosine deaminase comprises a D108N, D147Y, and E155V mutation in TadA reference sequence, or corresponding mutations in another adenosine deaminase (e.g., ecTadA). In some embodiments, the adenosine deaminase comprises a H8Y, D108N, and N127S mutation in TadA reference sequence, or corresponding mutations in another adenosine deaminase (e.g., ecTadA). In some embodiments, the adenosine deaminase comprises a A106V, D108N, D147Y and E155V mutation in TadA reference sequence, or corresponding mutations in another adenosine deaminase (e.g., ecTadA).

In some embodiments, the adenosine deaminase comprises one or more of a S2X, H8X, I49X, L84X, H123X, N127X, I156X and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, 149F, L84F, H123Y, N127S, I156F and/or K160S mutation in TadA reference sequence, or one or more corresponding mutations in another adenosine deaminase (e.g., ecTadA).

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase (e.g., ecTadA).

In some embodiments, the adenosine deaminase comprises an H123X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase (e.g., ecTadA).

In some embodiments, the adenosine deaminase comprises an 1157X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an I157F mutation in TadA reference sequence, or a corresponding mutation in another adenosine deaminase (e.g., ecTadA).

In some embodiments, the adenosine deaminase comprises one, two, three, four, five, six, or seven mutations selected from the group consisting of L84X, A106X, D108X, H123X, D147X, E155X, and I156X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in TadA reference sequence, or a corresponding mutation or mutations in another adenosine deaminase (e.g., ecTadA). In some embodiments, the adenosine deaminase comprises one, two, three, four, five, or six mutations selected from the group consisting of S2A, I49F, A106V, D108N, D147Y, and E155V in TadA reference sequence.

In some embodiments, the adenosine deaminase comprises one, two, three, four, or five, mutations selected from the group consisting of H8Y, A106T, D108N, N127S, and K160S in TadA reference sequence, or a corresponding mutation or mutations in another adenosine deaminase (e.g., ecTadA).

In some embodiments, the adenosine deaminase comprises one or more of a E25X, R26X, R107X, A142X, and/or A143X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in TadA reference sequence, or one or more corresponding mutations in another adenosine deaminase (e.g., ecTadA). In some embodiments, the adenosine deaminase comprises one or more of the mutations described herein corresponding to TadA reference sequence, or one or more corresponding mutations in another adenosine deaminase (e.g., ecTadA).

In some embodiments, the adenosine deaminase comprises an E25X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase (e.g., ecTadA).

In some embodiments, the adenosine deaminase comprises an R26X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase (e.g., ecTadA).

In some embodiments, the adenosine deaminase comprises an R107X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an R107P, R07K, R107A, R107N, R107W, R107H, or R107S mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase (e.g., ecTadA).

In some embodiments, the adenosine deaminase comprises an A143X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in TadA reference sequence, or a corresponding mutation in another adenosine deaminase (e.g., ecTadA).

In some embodiments, the adenosine deaminase comprises one or more of a H36X, N37X, P48X, I49X, R51X, M70X, N72X, D77X, E134X, S146X, Q154X, K157X, and/or K161X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in TadA reference sequence, or one or more corresponding mutations in another adenosine deaminase (e.g., ecTadA).

In some embodiments, the adenosine deaminase comprises an H36X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase (e.g., ecTadA).

In some embodiments, the adenosine deaminase comprises an N37X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an N37T, or N37S mutation in TadA reference sequence, or a corresponding mutation in another adenosine deaminase (e.g., ecTadA).

In some embodiments, the adenosine deaminase comprises an P48X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an P48T, or P48L mutation in TadA reference sequence, or a corresponding mutation in another adenosine deaminase (e.g., ecTadA).

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation in TadA reference sequence, or a corresponding mutation in another adenosine deaminase (e.g., ecTadA).

In some embodiments, the adenosine deaminase comprises an S146X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an S146R, or S146C mutation in TadA reference sequence, or a corresponding mutation in another adenosine deaminase (e.g., ecTadA).

In some embodiments, the adenosine deaminase comprises an K157X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase (e.g., ecTadA).

In some embodiments, the adenosine deaminase comprises an P48X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase (e.g., ecTadA).

In some embodiments, the adenosine deaminase comprises an W23X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a W23R, or W23L mutation in TadA reference sequence, or a corresponding mutation in another adenosine deaminase (e.g., ecTadA).

In some embodiments, the adenosine deaminase comprises an R152X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a R152P, or R52H mutation in TadA reference sequence, or a corresponding mutation in another adenosine deaminase (e.g., ecTadA).

In one embodiment, the adenosine deaminase may comprise the mutations H36L, R51L, L84F, A106V, D108N, H123Y, S146C, D147Y, E155V, I156F, and K157N. In some embodiments, the adenosine deaminase comprises the following combination of mutations relative to TadA reference sequence, where each mutation of a combination is separated by a "-" and each combination of mutations is between parentheses:

(A106V_D108N),
(R107C_D108N),
(H8Y_D108N_N127S_D147Y_Q154H),
(H8Y_R24W_D108N_N127S_D147Y_E155V),
(D108N_D147Y_E155V),
(H8Y_D108N_N127S),
(H8Y_D108N_N127S_D147Y_Q154H),
(A106V_D108N_D147Y_E155V),
(D108Q_D147Y_E155V),
(D108M_D147Y_E155V),
(D108L_D147Y_E155V),
(D108K_D147Y_E155V),
(D108I_D147Y_E155V),
(D108F_D147Y_E155V),
(A106V_D108N_D147Y),
(A106V_D108M_D147Y_E155V),
(E59A_A106V_D108N_D147Y_E155V),
(E59A cat dead_A106V_D108N_D147Y_E155V),
(L84F_A106V_D108N_H123Y_D147Y_E155V_I156Y),
(L84F_A106V_D108N_H123Y_D147Y_E155V_I156F),
(D103A_D104N),
(G22P_D103A_D104N),
(G22P_D103A_D104N_S138 A),
(D103A_D104N_S138A),
(R26G_L84F_A106V_R107H_D108N_H123Y_A142N_A143D_D147Y_E155V_I156F),
(E25G_R26G_L84F_A106V_R107H_D108N_H123Y_A142N_A143D_D147Y_E155V_I156F),
(E25D_R26G_L84F_A106V_R107K_D108N_H123Y_A142N_A143G_D147Y_E155V_I156F),
(R26Q_L84F_A106V_D108N_H123Y_A142N_D147Y_E155V_I156F),
(E25M_R26G_L84F_A106V_R107P_D108N_H123Y_A142N_A143D_D147Y_E155V_I156F),
(R26C_L84F_A106V_R107H_D108N_H123Y_A142N_D147Y_E155V_I156F),
(L84F_A106V_D108N_H123Y_A142N_A143L_D147Y_E155V_I156F),
(R26G_L84F_A106V_D108N_H123Y_A142N_D147Y_E155V_I156F),
(E25A_R26G_L84F_A106V_R107N_D108N_H123Y_A142N_A143E_D147Y_E155V_I156F),
(R26G_L84F_A106V_R107H_D108N_H123Y_A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_A143G_D147Y_E155V),
(R26G_A106V_D108N_R107H_A142N_A143D_D147Y_E155V),
(E25D_R26G_A106V_D108N_A142N_D147Y_E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_H123Y_S146C_D147Y_E155V_I156F_K157N),
(N37T_P48T_M70L_L84F_A106V_D108N_H123Y_D147Y_149V_E155V_I156F),
(N37S_L84F_A106V_D108N_H123Y_D147Y_E155V_I156F_K161T),
(H36L_L84F_A106V_D108N_H123Y_D147Y_Q154H_E155V_I156F),
(N72S_L84F_A106V_D108N_H123Y_S146R_D147Y_E155V_I156F),
(H36L_P48L_L84F_A106V_D108N_H123Y_E134G_D147Y_E155V_I156F),
(H36L_L84F_A106V_D108N_H123Y_D147Y_E155V_I156F_K157N),
(H36L_L84F_A106V_D108N_H123Y_S146C_D147Y_E155V_I156F),
(L84F_A106V_D108N_H123Y_S146R_D147Y_E155V_I156F_K161T),
(N37S_R51H_D77G_L84F_A106V_D108N_H123Y_D147Y_E155V_I156F),
(R51L_L84F_A106V_D108N_H123Y_D147Y_E155V_I156F_K157N),
(D24G_Q71R_L84F_H96L_A106V_D108N_H123Y_D147Y_E155V_I156F_K160E),
(H36L_G67V_L84F_A106V_D108N_H123Y_S146T_D147Y_E155V_I156F),
(Q71L_L84F_A106V_D108N_H123Y_L137M_A143E_D147Y_E155V_I156F),
(E25G_L84F_A106V_D108N_H123Y_D147Y_E155V_I156F_Q159L),
(L84F_A91T_F104I_A106V_D108N_H123Y_D147Y_E155V_I156F),
(N72D_L84F_A106V_D108N_H123Y_G125A_D147Y_E155V_I156F),
(P48S_L84F_S97C_A106V_D108N_H123Y_D147Y_E155V_I156F),
(W23G_L84F_A106V_D108N_H123Y_D147Y_E155V_I156F),
(D24G_P48L_Q71R_L84F_A106V_D108N_H123Y_D147Y_E155V_I156F_Q159L),
(L84F_A106V_D108N_H123Y_A142N_D147Y_E155V_I156F),
(H36L_R51L_L84F_A106V_D108N_H123Y_A142N_S146C_D147Y_E155V_I156F_K157N),
(N37S_L84F_A106V_D108N_H123Y_A142N_D147Y_E155V_I156F_K161T),
(L84F_A106V_D108N_D147Y_E155V_I156F),
(R51L_L84F_A106V_D108N_H123Y_S146C_D147Y_E155V_I156F_K157N_K161T),
(L84F_A106V_D108N_H123Y_S146C_D147Y_E155V_I156F_K161T), (L84F_A106V_D108N_H123Y_S146C_D147Y_E155V_I156F_K157N_K160E_K161T),
(L84F_A106V_D108N_H123Y_S146C_D147Y_E155V_I156F_K157N_K160E),
(R74Q_L84F_A106V_D108N_H123Y_D147Y_E155V_I156F),
(R74A_L84F_A106V_D108N_H123Y_D147Y_E155V_I156F),
(L84F_A106V_D108N_H123Y_D147Y_E155V_I156F),
(R74Q_L84F_A106V_D108N_H123Y_D147Y_E155V_I156F),
(L84F_R98Q_A106V_D108N_H123Y_D147Y_E155V_I156F),
(L84F_A106V_D108N_H123Y_R129Q_D147Y_E155V_I156F),
(P48S_L84F_A106V_D108N_H123Y_A142N_D147Y_E155V_I156F),
(P48S_A142N),
(P48T_149V_L84F_A106V_D108N_H123Y_A142N_D147Y_E155V_I156F_L157N),
(P48T_I49V_A142N),
(H36L_P48S_R51L_L84F_A106V_D108N_H123Y_S146C_D147Y_E155V_I156F_K157N),
(H36L_P48S_R51L_L84F_A106V_D108N_H123Y_S146C_A142N_D147Y_E155V_I156F
(H36L_P48T_149V_R51L_L84F_A106V_D108N_H123Y_S146C_D147Y_E155V_I156F_K157N),
(H36L_P48T_149V_R51L_L84F_A106V_D108N_H123Y_A142N_S146C_D147Y_E155V_I156F_K157N),
(H36L_P48A_R51L_L84F_A106V_D108N_H123Y_S146C_D147Y_E155V_I156F_K157N),
(H36L_P48A_R51L_L84F_A106V_D108N_H123Y_A142N_S146C_D147Y_E155V_I156F_K157N),
(H36L_P48A_R51L_L84F_A106V_D108N_H123Y_S146C_A142N_D147Y_E155V_I156F_K157N),
(W23L_H36L_P48A_R51L_L84F_A106V_D108N_H123Y_S146C_D147Y_E155V_I156F_K157N),
(W23R_H36L_P48A_R51L_L84F_A106V_D108N_H123Y_S146C_D147Y_E155V_I156F_K157N),
(W23L_H36L_P48A_R51L_L84F_A106V_D108N_H123Y_S146R_D147Y_E155V_I156F_K161T),
(H36L_P48A_R51L_L84F_A106V_D108N_H123Y_S146C_D147Y_R152H_E155V_I156F_K157N),
(H36L_P48A_R51L_L84F_A106V_D108N_H123Y_S146C_D147Y_R152P_E155V_I156F_K157N),
(W23L_H36L_P48A_R51L_L84F_A106V_D108N_H123Y_S146C_D147Y_R152P_E155V_I156F_K157N),
(W23L_H36L_P48A_R51L_L84F_A106V_D108N_H123Y_A142A_S146C_D147Y_E155V_I156F_K157N),
(W23L_H36L_P48A_R51L_L84F_A106V_D108N_H123Y_A142A_S146C_D147Y_R152P_E155V_I156F_K157N),
(W23L_H36L_P48A_R51L_L84F_A106V_D108N_H123Y_S146R_D147Y_E155V_I156F_K161T),
(W23R_H36L_P48A_R51L_L84F_A106V_D108N_H123Y_S146C_D147Y_R152P_E155V_I156F_K157N),
(H36L_P48A_R51L_L84F_A106V_D108N_H123Y_A142N_S146C_D147Y_R152P_E155V_I156F_K157N).

In some embodiments, the adenosine deaminase is TadA*7.10. In some embodiments, TadA*7.10 comprises at least one alteration. In particular embodiments, TadA*7.10 comprises one or more of the following alterations: Y147T, Y147R, Q154S, Y123H, V82S, T166R, and Q154R. The alteration Y123H is also referred to herein as H123H (the alteration H123Y in TadA*7.10 reverted back to Y123H (wt)). In other embodiments, the TadA*7.10 comprises a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+176Y; Y147R+Q154R+T166R; Y123H+Y147R+Q154R+176Y; V82S+Y123H+Y147R+Q154R; and I76Y+V82S+Y123H+Y147R+Q154R. In particular embodiments, an adenosine deaminase variant comprises a deletion of the C terminus beginning at residue 149, 150, 151, 152, 153, 154, 155, 156, and 157.

In other embodiments, the base editor comprises TadA*7.10 and TadA (wt), which are capable of forming heterodimers. Exemplary sequences follow:

```
TadA(wt):
                                         (SEQ ID NO: 255)
MSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIHSR

IGRVVFGARDAKTGAAGSLMDVLHHPGMNHRVEITEGILADECAALLSD

FFRMRRQEIKAQKKAQSSTD

TadA*7.10:
                                         (SEQ ID NO: 164)
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD
```

In one embodiment, a fusion protein of the invention comprises a wild-type TadA is linked to an adenosine deaminase variant described herein, which is linked to Cas9 nickase.

C to T Editing

A fusion protein of the invention comprises one or more nucleic acid editing domains. In some embodiments, a base editor disclosed herein comprises a fusion protein comprising cytidine deaminase capable of deaminating a target cytidine (C) base of a polynucleotide to produce uridine (U), which has the base pairing properties of thymine. In some embodiments, for example where the polynucleotide is double-stranded (e.g., DNA), the uridine base can then be substituted with a thymidine base (e.g., by cellular repair machinery) to give rise to a C:G to a T:A transition. In other embodiments, deamination of a C to U in a nucleic acid by a base editor cannot be accompanied by substitution of the U to a T.

The deamination of a target C in a polynucleotide to give rise to a U is a non-limiting example of a type of base editing that can be executed by a base editor described herein. In another example, a base editor comprising a cytidine deaminase domain can mediate conversion of a cytosine (C) base to a guanine (G) base. For example, a U of a polynucleotide produced by deamination of a cytidine by a cytidine deaminase domain of a base editor can be excised from the polynucleotide by a base excision repair mechanism (e.g., by a uracil DNA glycosylase (UDG) domain), producing an abasic site. The nucleobase opposite the abasic site can then be substituted (e.g., by base repair machinery) with another base, such as a C, by for example a translesion polymerase.

Although it is typical for a nucleobase opposite an abasic site to be replaced with a C, other substitutions (e.g., A, G or T) can also occur.

Accordingly, in some embodiments a base editor described herein comprises a deamination or deaminase domain (e.g., cytidine deaminase domain) capable of deaminating a target C to a U in a polynucleotide. Further, as described below, the base editor can comprise additional domains which facilitate conversion of the U resulting from deamination to, in some embodiments, a T or a G. For example, a base editor comprising a cytidine deaminase domain can further comprise a uracil glycosylase inhibitor (UGI) domain to mediate substitution of a U by a T, completing a C-to-T base editing event. In another example, a base editor can incorporate a translesion polymerase to improve the efficiency of C-to-G base editing, since a translesion polymerase can facilitate incorporation of a C opposite an abasic site (i.e., resulting in incorporation of a G at the abasic site, completing the C-to-G base editing event).

A base editor comprising a cytidine deaminase as a domain can deaminate a target C in any polynucleotide, including DNA, RNA and DNA-RNA hybrids. Typically, a cytidine deaminase catalyzes a C nucleobase that is positioned in the context of a single-stranded portion of a polynucleotide. In some embodiments, the entire polynucleotide comprising a target C can be single-stranded. For example, a cytidine deaminase incorporated into the base editor can deaminate a target C in a single-stranded RNA polynucleotide. In other embodiments, a base editor comprising a cytidine deaminase domain can act on a double-stranded polynucleotide, but the target C can be positioned in a portion of the polynucleotide which at the time of the deamination reaction is in a single-stranded state. For example, in embodiments where the NAGPB domain comprises a Cas9 domain, several nucleotides can be left unpaired during formation of the Cas9-gRNA-target DNA complex, resulting in formation of a Cas9 "R-loop complex". These unpaired nucleotides can form a bubble of single-stranded DNA that can serve as a substrate for a single-strand specific nucleotide deaminase enzyme (e.g., cytidine deaminase).

Details of C to T nucleobase editing proteins are described in International PCT Application No. PCT/US2016/058344 (WO2017/070632) and Komor, A. C., et al., "Programmable editing of a target base in genomic DNA without double-stranded DNA cleavage" Nature 533, 420-424 (2016), the entire contents of which are hereby incorporated by reference.

Cytidine Deaminases

The fusion proteins provided herein comprise a cytidine deaminase. In some embodiments, the cytidine deaminases provided herein are capable of deaminating cytosine or 5-methylcytosine to uracil or thymine. In some embodiments, the cytidine deaminases provided herein are capable of deaminating cytosine in DNA. The cytidine deaminase may be derived from any suitable organism. In some embodiments, the cytidine deaminase is a naturally-occurring cytidine deaminase that includes one or more mutations corresponding to any of the mutations provided herein. One of skill in the art will be able to identify the corresponding residue in any homologous protein, e.g., by sequence alignment and determination of homologous residues. Accordingly, one of skill in the art would be able to generate mutations in any naturally-occurring cytidine deaminase that corresponds to any of the mutations described herein. In some embodiments, the cytidine deaminase is from a prokaryote. In some embodiments, the cytidine deaminase is from a bacterium. In some embodiments, the cytidine deaminase is from a mammal (e.g., human).

In some embodiments, the cytidine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the cytidine deaminase amino acid sequences set forth herein. It should be appreciated that cytidine deaminases provided herein may include one or more mutations (e.g., any of the mutations provided herein). The disclosure provides any deaminase domains with a certain percent identity plus any of the mutations or combinations thereof described herein. In some embodiments, the cytidine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the cytidine deaminases provided herein. In some embodiments, the cytidine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments, a cytidine deaminase of a base editor can comprise all or a portion of an apolipoprotein B mRNA editing complex (APOBEC) family deaminase. APOBEC is a family of evolutionarily conserved cytidine deaminases. Members of this family are C-to-U editing enzymes. The N-terminal domain of APOBEC like proteins is the catalytic domain, while the C-terminal domain is a pseudocatalytic domain. More specifically, the catalytic domain is a zinc dependent cytidine deaminase domain and is important for cytidine deamination. APOBEC family members include APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, and Activation-induced (cytidine) deaminase. In some embodiments, a deaminase incorporated into a base editor comprises all or a portion of an APOBEC1 deaminase. In some embodiments, a deaminase incorporated into a base editor comprises all or a portion of APOBEC2 deaminase. In some embodiments, a deaminase incorporated into a base editor comprises all or a portion of is an APOBEC3 deaminase. In some embodiments, a deaminase incorporated into a base editor comprises all or a portion of an APOBEC3A deaminase. In some embodiments, a deaminase incorporated into a base editor comprises all or a portion of APOBEC3B deaminase. In some embodiments, a deaminase incorporated into a base editor comprises all or a portion of APOBEC3C deaminase. In some embodiments, a deaminase incorporated into a base editor comprises all or a portion of APOBEC3D deaminase. In some embodiments, a deaminase incorporated into a base editor comprises all or a portion of APOBEC3E deaminase. In some embodiments, a deaminase incorporated into a base editor comprises all or a portion of APOBEC3F deaminase. In some embodiments, a deaminase incorporated into a base editor comprises all or a portion of APOBEC3G deaminase. In some embodiments, a deaminase incorporated into a base editor comprises all or a portion of APOBEC3H deaminase. In some embodiments, a deaminase incorporated into a base editor comprises all or a portion of APOBEC4 deaminase. In some embodiments, a deaminase incorporated into a base editor comprises all or a portion of activation-induced deaminase (AID). In some embodiments a deaminase incorporated into a base editor comprises all or a portion of cytidine deaminase 1 (CDA1).

In some embodiments, the cytidine deaminase includes, without limitation: APOBEC family members, including but not limited to: APOBEC1, APOBEC2, APOBEC3A, APOBEC3B, APOBEC3C, APOBEC3D ("APOBEC3E" now refers to this), APOBEC3F, APOBEC3G, APOBEC3H, APOBEC4, Activation-induced (cytidine) deaminase (AID), hAPOBEC1, which is derived from *Homo sapiens*, rAPOBEC1, which is derived from *Rattus norvegicus*, ppAPOBEC1, which is derived from *Pongo pygmaeus*, AmAPOBEC1 (BEM3.31), derived from *Alligator mississippiensis*, ocAPOBEC1, which is derived from *Oryctolagus cuniculus*, SsAPOBEC2 (BEM3.39), which is derived from *Sus scrofa*, hAPOBEC3A, which is derived from *Homo sapiens*, maAPOBEC1, which is derived from *Mesocricetus auratus*, mdAPOBEC1, which is derived from *Monodelphis domestica*; cytidine deaminase 1 (CDA1), hA3A, which is APOBEC3A derived from *Homo sapiens*, RrA3F (BEM3.14), which is APOBEC3F derived from *Rhinopithecus roxellana*; PmCDA1, which is derived from *Petromyzon marinus* (*Petromyzon marinus* cytosine deaminase 1, "PmCDA1"); AID (Activation-induced cytidine deaminase; AICDA), which is derived from a mammal (e.g., human, swine, bovine, horse, monkey etc.); hAID, which is derived from *Homo sapiens*; and FENRY.

It should be appreciated that a base editor can comprise a deaminase from any suitable organism (e.g., a human or a rat). In some embodiments, the deaminase is a vertebrate deaminase. In some embodiments, the deaminase is an invertebrate deaminase. In some embodiments, a deaminase domain of a base editor is from a human, chimpanzee, gorilla, monkey, cow, dog, rat, or mouse deaminase. In some embodiments, the deaminase is a human deaminase. In some embodiments, the deaminase is human APOBEC1 (hAPOBEC1). In some embodiments, the deaminase is human APOBEC3C (hAPOBEC3C or hA3C). In some embodiments, the deaminase is human APOBEC3A (hAPOBEC3A or hA3A). In some embodiments, the deaminase is human AID (hAID). In some embodiments, the deaminase is a human APOBEC3G. In some embodiments, the deaminase is a fragment of the human APOBEC3G. In some embodiments, the deaminase is a human APOBEC3G variant comprising a D316R D317R mutation. In some embodiments, the deaminase is a fragment of the human APOBEC3G and comprises mutations corresponding to the D316R D317R mutations.

In some embodiments, the deaminase is a rat deaminase. In some embodiments, the deaminase is rat APOBEC1 (rAPOBEC1). In some embodiments, the deaminase is a *Pongo pygmaeus* APOBEC1 (ppAPOBEC1). In some embodiments, the deaminase is a *Petromyzon marinus* cytidine deaminase 1 (pmCDA1). In some embodiments, the deaminase is a *Mesocricetus auratus* deaminase (maAPOBEC1). In some embodiments, the deaminase is a *Monodelphis domestica* deaminase (mdAPOBEC1). In some embodiments, the deaminase is a *Rhinopithecus roxellana* APOBEC3F (RrA3F (BEM3.14)). In some embodiments, the deaminase is an *Alligator mississippiensis* APOBEC1 (AmAPOBEC1 (BEM3.31)). In some embodiments, the deaminase is a *Sus scrofa* APOBEC2 (SsAPOBEC2 (BEM3.39)). In some embodiments, the nucleic acid editing domain is at least 80%, at least 85%, at least 90%, at least 92%, at least 95%, at least 96%, at least 97%, at least 98%, at least 99%), or at least 99.5% identical to the deaminase domain of any deaminase described herein.

The amino acid and nucleic acid sequences of PmCDA1 are shown herein below. >tr|A5H718|A5H718_PETMA Cytosine deaminase OS=*Petromyzon marinus* OX=7757 PE=2 SV=1 amino acid sequence:

(SEQ ID NO: 258)

```
MTDAEYVRIHEKLDIYTFKKQFFNNKKSVSHRCYVLFELKRRGERRACF
WGYAVNKPQSGTERGIHAEIFSIRKVEEYLRDNPGQFTINWYSSWSPCA
DCAEKILEWYNQELRGNGHTLKIWACKLYYEKNARNQIGLWNLRDNGVG
LNVMVSEHYQCCRKIFIQSSHNQLNENRWLEKTLKRAEKRRSELSIMIQ
VKILHTTKSPAV
```

Nucleic acid sequence: >EF094822.1 *Petromyzon marinus* isolate PmCDA.21 cytosine deaminase mRNA, complete cds:

(SEQ ID NO: 259)

```
TGACACGACACAGCCGTGTATATGAGGAAGGGTAGCTGGATGGGGGGG
GGGGAATACGTTCAGAGAGGACATTAGCGAGCGTCTTGTTGGTGGCCTT
GAGTCTAGACACCTGCAGACATGACCGACGCTGAGTACGTGAGAATCCA
TGAGAAGTTGGACATCTACACGTTTAAGAAACAGTTTTTCAACAACAAA
AAATCCGTGTCGCATAGATGCTACGTTCTCTTTGAATTAAAACGACGGG
GTGAACGTAGAGCGTGTTTTTGGGGCTATGCTGTGAATAAACCACAGAG
CGGGACAGAACGTGGAATTCACGCCGAAATCTTTAGCATTAGAAAAGTC
GAAGAATACCTGCGCGACAACCCCGGACAATTCACGATAAATTGGTACT
CATCCTGGAGTCCTTGTGCAGATTGCGCTGAAAAGATCTTAGAATGGTA
TAACCAGGAGCTGCGGGGGAACGGCCACACTTTGAAAATCTGGGCTTGC
AAACTCTATTACGAGAAAAATGCGAGGAATCAAATTGGGCTGTGGAACC
TCAGAGATAACGGGGTTGGGTTGAATGTAATGGTAAGTGAACACTACCA
ATGTTGCAGGAAAATATTCATCCAATCGTCGCACAATCAATTGAATGAG
AATAGATGGCTTGAGAAGACTTTGAAGCGAGCTGAAAAACGACGGAGCG
AGTTGTCCATTATGATTCAGGTAAAAATACTCCACACCACTAAGAGTCC
TGCTGTTTAAGAGGCTATGCGGATGGTTTTC
```

The amino acid and nucleic acid sequences of the coding sequence (CDS) of human activation-induced cytidine deaminase (AID) are shown below.

>tr|Q6QJ80|Q6QJ80_HUMAN Activation-induced cytidine deaminase OS=*Homo sapiens* OX=9606 GN=AICDA PE=2 SV=1 amino acid sequence:

(SEQ ID NO: 260)

```
MDSLLMNRRKFLYQFKNVRWAKGRRETYLCYVVKRRDSATSFSLDFGYL
RNKNGCHVELLFLRYISDWDLDPGRCYRVTWFTSWSPCYDCARHVADFL
RGNPNLSLRIFTARLYFCEDRKAEPEGLRRLHRAGVQIAIMTFKAPV
```

Nucleic acid sequence: >NG_011588.1:5001-15681 *Homo sapiens* activation induced cytidine deaminase (AICDA), RefSeqGene (LRG_17) on chromosome 12:

(SEQ ID NO: 261)
AGAGAACCATCATTAATTGAAGTGAGATTTTTCTGGCCTGAGACTTGCAGGGAGGCAAGAAG

ACACTCTGGACACCACTATGGACAGGTAAAGAGGCAGTCTTCTCGTGGGTGATTGCACTGGC

CTTCCTCTCAGAGCAAATCTGAGTAATGAGACTGGTAGCTATCCCTTTCTCTCATGTAACTG

TCTGACTGATAAGATCAGCTTGATCAATATGCATATATATTTTTTGATCTGTCTCCTTTTCT

TCTATTCAGATCTTATACGCTGTCAGCCCAATTCTTTCTGTTTCAGACTTCTCTTGATTTCC

CTCTTTTTCATGTGGCAAAAGAAGTAGTGCGTACAATGTACTGATTCGTCCTGAGATTTGTA

CCATGGTTGAAACTAATTTATGGTAATAATATTAACATAGCAAATCTTTAGAGACTCAAATC

ATGAAAAGGTAATAGCAGTACTGTACTAAAAACGGTAGTGCTAATTTTCGTAATAATTTTGT

AAATATTCAACAGTAAAACAACTTGAAGACACACTTTCCTAGGGAGGCGTTACTGAAATAAT

TTAGCTATAGTAAGAAAATTTGTAATTTTAGAAATGCCAAGCATTCTAAATTAATTGCTTGA

AAGTCACTATGATTGTGTCCATTATAAGGAGACAAATTCATTCAAGCAAGTTATTTAATGTT

AAAGGCCCAATTGTTAGGCAGTTAATGGCACTTTTACTATTAACTAATCTTTCCATTTGTTC

AGACGTAGCTTAACTTACCTCTTAGGTGTGAATTTGGTTAAGGTCCTCATAATGTCTTTATG

TGCAGTTTTTGATAGGTTATTGTCATAGAACTTATTCTATTCCTACATTTATGATTACTATG

GATGTATGAGAATAACACCTAATCCTTATACTTTACCTCAATTTAACTCCTTTATAAAGAAC

TTACATTACAGAATAAAGATTTTTTAAAAATATATTTTTTTGTAGAGACAGGGTCTTAGCCC

AGCCGAGGCTGGTCTCTAAGTCCTGGCCCAAGCGATCCTCCTGCCTGGGCCTCCTAAAGTGC

TGGAATTATAGACATGAGCCATCACATCCAATATACAGAATAAAGATTTTTAATGGAGGATT

TAATGTTCTTCAGAAAATTTTCTTGAGGTCAGACAATGTCAAATGTCTCCTCAGTTTACACT

GAGATTTTGAAAACAAGTCTGAGCTATAGGTCCTTGTGAAGGGTCCATTGGAAATACTTGTT

CAAAGTAAAATGGAAAGCAAAGGTAAAATCAGCAGTTGAAATTCAGAGAAAGACAGAAAAGG

AGAAAAGATGAAATTCAACAGGACAGAAGGGAAATATATTATCATTAAGGAGGACAGTATCT

GTAGAGCTCATTAGTGATGGCAAAATGACTTGGTCAGGATTATTTTTAACCCGCTTGTTTCT

GGTTTGCACGGCTGGGGATGCAGCTAGGGGTTCTGCCTCAGGGAGCACAGCTGTCCAGAGCAG

CTGTCAGCCTGCAAGCCTGAAACACTCCCTCGGTAAAGTCCTTCCTACTCAGGACAGAAATG

ACGAGAACAGGGAGCTGGAAACAGGCCCCTAACCAGAGAAGGGAAGTAATGGATCAACAAAG

TTAACTAGCAGGTCAGGATCACGCAATTCATTTCACTCTGACTGGTAACATGTGACAGAAAC

AGTGTAGGCTTATTGTATTTTCATGTAGAGTAGGACCCAAAAATCCACCCAAAGTCCTTTAT

CTATGCCACATCCTTCTTATCTATACTTCCAGGACACTTTTTCTTCCTTATGATAAGGCTCT

CTCTCTCTCCACACACACACACACACACACACACACACACACACACACACACACAAACACAC

ACCCCGCCAACCAAGGTGCATGTAAAAAGATGTAGATTCCTCTGCCTTTCTCATCTACACAG

CCCAGGAGGGTAAGTTAATATAAGAGGGATTTATTGGTAAGAGATGATGCTTAATCTGTTTA

ACACTGGGCCTCAAAGAGAGAATTTCTTTTCTTCTGTACTTATTAAGCACCTATTATGTGTT

GAGCTTATATATACAAAGGGTTATTATATGCTAATATAGTAATAGTAATGGTGGTTGGTACT

ATGGTAATTACCATAAAAATTATTATCCTTTTAAAATAAAGCTAATTATTATTGGATCTTTT

TTAGTATTCATTTTATGTTTTTTATGTTTTTGATTTTTTAAAAGACAATCTCACCCTGTTAC

CCAGGCTGGAGTGCAGTGGTGCAATCATAGCTTTCTGCAGTCTTGAACTCCTGGGCTCAAGC

AATCCTCCTGCCTTGGCCTCCCAAAGTGTTGGGATACAGTCATGAGCCACTGCATCTGGCCT

AGGATCCATTTAGATTAAAATATGCATTTTAAATTTTAAAATAATATGGCTAATTTTTACCT

TATGTAATGTGTATACTGGCAATAAATCTAGTTTGCTGCCTAAAGTTTAAAGTGCTTTCCAG

-continued

TAAGCTTCATGTACGTGAGGGGAGACATTTAAAGTGAAACAGACAGCCAGGTGTGGTGGCTC

ACGCCTGTAATCCCAGCACTCTGGGAGGCTGAGGTGGGTGGATCGCTTGAGCCCTGGAGTTC

AAGACCAGCCTGAGCAACATGGCAAAACGCTGTTTCTATAACAAAAATTAGCCGGGCATGGT

GGCATGTGCCTGTGGTCCCAGCTACTAGGGGGCTGAGGCAGGAGAATCGTTGGAGCCCAGGA

GGTCAAGGCTGCACTGAGCAGTGCTTGCGCCACTGCACTCCAGCCTGGGTGACAGGACCAGA

CCTTGCCTCAAAAAAATAAGAAGAAAAATTAAAAATAAATGGAAACAACTACAAAGAGCTGT

TGTCCTAGATGAGCTACTTAGTTAGGCTGATATTTTGGTATTTAACTTTTAAAGTCAGGGTC

TGTCACCTGCACTACATTATTAAAATATCAATTCTCAATGTATATCCACACAAAGACTGGTA

CGTGAATGTTCATAGTACCTTTATTCACAAAACCCCAAAGTAGAGACTATCCAAATATCCAT

CAACAAGTGAACAAATAAACAAAATGTGCTATATCCATGCAATGGAATACCACCCTGCAGTA

CAAAGAAGCTACTTGGGGATGAATCCCAAAGTCATGACGCTAAATGAAAGAGTCAGACATGA

AGGAGGAGATAATGTATGCCATACGAAATTCTAGAAAATGAAAGTAACTTATAGTTACAGAA

AGCAAATCAGGGCAGGCATAGAGGCTCACACCTGTAATCCCAGCACTTTGAGAGGCCACGTG

GGAAGATTGCTAGAACTCAGGAGTTCAAGACCAGCCTGGGCAACACAGTGAAACTCCATTCT

CCACAAAAATGGGAAAAAAAGAAAGCAAATCAGTGGTTGTCCTGTGGGGAGGGGAAGGACTG

CAAAGAGGGAAGAAGCTCTGGTGGGGTGAGGGTGGTGATTCAGGTTCTGTATCCTGACTGTG

GTAGCAGTTTGGGGTGTTTACATCCAAAAATATTCGTAGAATTATGCATCTTAAATGGGTGG

AGTTTACTGTATGTAAATTATACCTCAATGTAAGAAAAAATAATGTGTAAGAAAACTTTCAA

TTCTCTTGCCAGCAAACGTTATTCAAATTCCTGAGCCCTTTACTTCGCAAATTCTCTGCACT

TCTGCCCCGTACCATTAGGTGACAGCACTAGCTCCACAAATTGGATAAATGCATTTCTGGAA

AAGACTAGGGACAAAATCCAGGCATCACTTGTGCTTTCATATCAACCATGCTGTACAGCTTG

TGTTGCTGTCTGCAGCTGCAATGGGGACTCTTGATTTCTTTAAGGAAACTTGGGTTACCAGA

GTATTTCCACAAATGCTATTCAAATTAGTGCTTATGATATGCAAGACACTGTGCTAGGAGCC

AGAAAACAAAGAGGAGGAGAAATCAGTCATTATGTGGGAACAACATAGCAAGATATTTAGAT

CATTTTGACTAGTTAAAAAAGCAGCAGAGTACAAAATCACACATGCAATCAGTATAATCCAA

ATCATGTAAATATGTGCCTGTAGAAAGACTAGAGGAATAAACACAAGAATCTTAACAGTCAT

TGTCATTAGACACTAAGTCTAATTATTATTATTAGACACTATGATATTTGAGATTTAAAAAA

TCTTTAATATTTTAAAATTTAGAGCTCTTCTATTTTTCCATAGTATTCAAGTTTGACAATGA

TCAAGTATTACTCTTTCTTTTTTTTTTTTTTTTTTTTTTTTTTGAGATGGAGTTTTGGTCTTG

TTGCCCATGCTGGAGTGGAATGGCATGACCATAGCTCACTGCAACCTCCACCTCCTGGGTTC

AAGCAAAGCTGTCGCCTCAGCCTCCCGGGTAGATGGGATTACAGGCGCCCACCACCACACTC

GGCTAATGTTTGTATTTTTAGTAGAGATGGGGTTTCACCATGTTGGCCAGGCTGGTCTCAAA

CTCCTGACCTCAGAGGATCCACCTGCCTCAGCCTCCCAAAGTGCTGGGATTACAGATGTAGG

CCACTGCGCCCGGCCAAGTATTGCTCTTATACATTAAAAAACAGGTGTGAGCCACTGCGCCC

AGCCAGGTATTGCTCTTATACATTAAAAAATAGGCCGGTGCAGTGGCTCACGCCTGTAATCC

CAGCACTTTGGGAAGCCAAGGCGGGCAGAACACCCGAGGTCAGGAGTCCAAGGCCAGCCTGG

CCAAGATGGTGAAACCCCGTCTCTATTAAAAATACAAACATTACCTGGGCATGATGGTGGGC

GCCTGTAATCCCAGCTACTCAGGAGGCTGAGGCAGGAGGATCCGCGGAGCCTGGCAGATCTG

CCTGAGCCTGGGAGGTTGAGGCTACAGTAAGCCAAGATCATGCCAGTATACTTCAGCCTGGG

CGACAAAGTGAGACCGTAACAAAAAAAAAAAAAATTTAAAAAAAGAAATTTAGATCAAGATCC

AACTGTAAAAAGTGGCCTAAACACCACATTAAAGAGTTTGGAGTTTATTCTGCAGGCAGAAG

-continued

AGAACCATCAGGGGGTCTTCAGCATGGGAATGGCATGGTGCACCTGGTTTTTGTGAGATCAT

GGTGGTGACAGTGTGGGGAATGTTATTTTGGAGGGACTGGAGGCAGACAGACCGGTTAAAAG

GCCAGCACAACAGATAAGGAGGAAGAAGATGAGGGCTTGGACCGAAGCAGAGAAGAGCAAAC

AGGGAAGGTACAAATTCAAGAAATATTGGGGGGTTTGAATCAACACATTTAGATGATTAATT

AAATATGAGGACTGAGGAATAAGAAATGAGTCAAGGATGGTTCCAGGCTGCTAGGCTGCTTA

CCTGAGGTGGCAAAGTCGGGAGGAGTGGCAGTTTAGGACAGGGGGCAGTTGAGGAATATTGT

TTTGATCATTTTGAGTTTGAGGTACAAGTTGGACACTTAGGTAAAGACTGGAGGGGAAATCT

GAATATACAATTATGGGACTGAGGAACAAGTTTATTTTATTTTTTGTTTCGTTTTCTTGTTG

AAGAACAAATTTAATTGTAATCCCAAGTCATCAGCATCTAGAAGACAGTGGCAGGAGGTGAC

TGTCTTGTGGGTAAGGGTTTGGGGTCCTTGATGAGTATCTCTCAATTGGCCTTAAATATAAG

CAGGAAAAGGAGTTTATGATGGATTCCAGGCTCAGCAGGGCTCAGGAGGGCTCAGGCAGCCA

GCAGAGGAAGTCAGAGCATCTTCTTTGGTTTAGCCCAAGTAATGACTTCCTTAAAAAGCTGA

AGGAAAATCCAGAGTGACCAGATTATAAACTGTACTCTTGCATTTTCTCTCCCTCCTCTCAC

CCACAGCCTCTTGATGAACCGGAGGAAGTTTCTTTACCAATTCAAAAATGTCCGCTGGGCTA

AGGGTCGGCGTGAGACCTACCTGTGCTACGTAGTGAAGAGGCGTGACAGTGCTACATCCTTT

TCACTGGACTTTGGTTATCTTCGCAATAAGGTATCAATTAAAGTCGGCTTTGCAAGCAGTTT

AATGGTCAACTGTGAGTGCTTTTAGAGCCACCTGCTGATGGTATTACTTCCATCCTTTTTTG

GCATTTGTGTCTCTATCACATTCCTCAAATCCTTTTTTTTATTTCTTTTTCCATGTCCATGC

ACCCATATTAGACATGGCCCAAAATATGTGATTTAATTCCTCCCCAGTAATGCTGGGCACCC

TAATACCACTCCTTCCTTCAGTGCCAAGAACAACTGCTCCCAAACTGTTTACCAGCTTTCCT

CAGCATCTGAATTGCCTTTGAGATTAATTAAGCTAAAAGCATTTTTATATGGGAGAATATTA

TCAGCTTGTCCAAGCAAAAATTTTAAATGTGAAAAACAAATTGTGTCTTAAGCATTTTTGAA

AATTAAGGAAGAAGAATTTGGGAAAAAATTAACGGTGGCTCAATTCTGTCTTCCAAATGATT

TCTTTTCCCTCCTACTCACATGGGTCGTAGGCCAGTGAATACATTCAACATGGTGATCCCCA

GAAAACTCAGAGAAGCCTCGGCTGATGATTAATTAAATTGATCTTTCGGCTACCCGAGAGAA

TTACATTTCCAAGAGACTTCTTCACCAAAATCCAGATGGGTTTACATAAACTTCTGCCCACG

GGTATCTCCTCTCTCCTAACACGCTGTGACGTCTGGGCTTGGTGGAATCTCAGGGAAGCATC

CGTGGGGTGGAAGGTCATCGTCTGGCTCGTTGTTTGATGGTTATATTACCATGCAATTTTCT

TTGCCTACATTTGTATTGAATACATCCCAATCTCCTTCCTATTCGGTGACATGACACATTCT

ATTTCAGAAGGCTTTGATTTTATCAAGCACTTTCATTTACTTCTCATGGCAGTGCCTATTAC

TTCTCTTACAATACCCATCTGTCTGCTTTACCAAAATCTATTTCCCCTTTTCAGATCCTCCC

AAATGGTCCTCATAAACTGTCCTGCCTCCACCTAGTGGTCCAGGTATATTTCCACAATGTTA

CATCAACAGGCACTTCTAGCCATTTTCCTTCTCAAAAGGTGCAAAAAGCAACTTCATAAACA

CAAATTAAATCTTCGGTGAGGTAGTGTGATGCTGCTTCCTCCCAACTCAGCGCACTTCGTCT

TCCTCATTCCACAAAAACCCATAGCCTTCCTTCACTCTGCAGGACTAGTGCTGCCAAGGGTT

CAGCTCTACCTACTGGTGTGCTCTTTTGAGCAAGTTGCTTAGCCTCTCTGTAACACAAGGAC

AATAGCTGCAAGCATCCCCAAAGATCATTGCAGGAGACAATGACTAAGGCTACCAGAGCCGC

AATAAAAGTCAGTGAATTTTAGCGTGGTCCTCTCTGTCTCTCCAGAACGGCTGCCACGTGGA

ATTGCTCTTCCTCCGCTACATCTCGGACTGGGACCTAGACCCTGGCCGCTGCTACCGCGTCA

CCTGGTTCACCTCCTGGAGCCCCTGCTACGACTGTGCCCGACATGTGGCCGACTTTCTGCGA

-continued

GGGAACCCCAACCTCAGTCTGAGGATCTTCACCGCGCGCCTCTACTTCTGTGAGGACCGCAA

GGCTGAGCCCGAGGGGCTGCGGCGGCTGCACCGCGCCGGGGTGCAAATAGCCATCATGACCT

TCAAAGGTGCGAAAGGGCCTTCCGCGCAGGCGCAGTGCAGCAGCCCGCATTCGGGATTGCGA

TGCGGAATGAATGAGTTAGTGGGGAAGCTCGAGGGGAAGAAGTGGGGGGGGATTCTGGTTCA

CCTCTGGAGCCGAAATTAAAGATTAGAAGCAGAGAAAAGAGTGAATGGCTCAGAGACAAGGC

CCCGAGGAAATGAGAAAATGGGGCCAGGGTTGCTTCTTTCCCCTCGATTTGGAACCTGAACT

GTCTTCTACCCCCATATCCCCGCCTTTTTTTCCTTTTTTTTTTTTTGAAGATTATTTTTACT

GCTGGAATACTTTTGTAGAAAACCACGAAAGAACTTTCAAAGCCTGGGAAGGGCTGCATGAA

AATTCAGTTCGTCTCTCCAGACAGCTTCGGCGCATCCTTTTGGTAAGGGGCTTCCTCGCTTT

TTAAATTTTCTTTCTTTCTCTACAGTCTTTTTTGGAGTTTCGTATATTTCTTATATTTTCTT

ATTGTTCAATCACTCTCAGTTTTCATCTGATGAAAACTTTATTTCTCCTCCACATCAGCTTT

TTCTTCTGCTGTTTCACCATTCAGAGCCCTCTGCTAAGGTTCCTTTTCCCTCCCTTTTCTTT

CTTTTGTTGTTTCACATCTTTAAATTTCTGTCTCTCCCCAGGGTTGCGTTTCCTTCCTGGTC

AGAATTCTTTTCTCCTTTTTTTTTTTTTTTTTTTTTTTTTTTTAAACAAACAAACAAAAAACC

CAAAAAAACTCTTTCCCAATTTACTTTCTTCCAACATGTTACAAAGCCATCCACTCAGTTTA

GAAGACTCTCCGGCCCCACCGACCCCCAACCTCGTTTTGAAGCCATTCACTCAATTTGCTTC

TCTCTTTCTCTACAGCCCCTGTATGAGGTTGATGACTTACGAGACGCATTTCGTACTTTGGG

ACTTTGATAGCAACTTCCAGGAATGTCACACACGATGAAATATCTCTGCTGAAGACAGTGGA

TAAAAAACAGTCCTTCAAGTCTTCTCTGTTTTTATTCTTCAACTCTCACTTTCTTAGAGTTT

ACAGAAAAAATATTTATATACGACTCTTTAAAAAGATCTATGTCTTGAAAATAGAGAAGGAA

CACAGGTCTGGCCAGGGACGTGCTGCAATTGGTGCAGTTTTGAATGCAACATTGTCCCCTAC

TGGGAATAACAGAACTGCAGGACCTGGGAGCATCCTAAAGTGTCAACGTTTTTCTATGACTT

TTAGGTAGGATGAGAGCAGAAGGTAGATCCTAAAAAGCATGGTGAGAGGATCAAATGTTTTT

ATATCAACATCCTTTATTATTTGATTCATTTGAGTTAACAGTGGTGTTAGTGATAGATTTTT

CTATTCTTTTCCCTTGACGTTTACTTTCAAGTAACACAAACTCTTCCATCAGGCCATGATCT

ATAGGACCTCCTAATGAGAGTATCTGGGTGATTGTGACCCCAAACCATCTCTCCAAAGCATT

AATATCCAATCATGCGCTGTATGTTTTAATCAGCAGAAGCATGTTTTTATGTTTGTACAAAA

GAAGATTGTTATGGGTGGGGATGGAGGTATAGACCATGCATGGTCACCTTCAAGCTACTTTA

ATAAAGGATCTTAAAATGGGCAGGAGGACTGTGAACAAGACACCCTAATAATGGGTTGATGT

CTGAAGTAGCAAATCTTCTGGAAACGCAAACTCTTTTAAGGAAGTCCCTAATTTAGAAACAC

CCACAAACTTCACATATCATAATTAGCAAACAATTGGAAGGAAGTTGCTTGAATGTTGGGGA

GAGGAAAATCTATTGGCTCTCGTGGGTCTCTTCATCTCAGAAATGCCAATCAGGTCAAGGTT

TGCTACATTTTGTATGTGTGTGATGCTTCTCCCAAAGGTATATTAACTATATAAGAGAGTTG

TGACAAAACAGAATGATAAAGCTGCGAACCGTGGCACACGCTCATAGTTCTAGCTGCTTGGG

AGGTTGAGGAGGGAGGATGGCTTGAACACAGGTGTTCAAGGCCAGCCTGGGCAACATAACAA

GATCCTGTCTCTCAAAAAAAAAAAAAAAAAAAAAGAAAGAGAGAGGGCCGGGCGTGGTGGCTC

ACGCCTGTAATCCCAGCACTTTGGGAGGCCGAGCCGGGCGGATCACCTGTGGTCAGGAGTTT

GAGACCAGCCTGGCCAACATGGCAAAACCCCGTCTGTACTCAAAATGCAAAAATTAGCCAGG

CGTGGTAGCAGGCACCTGTAATCCCAGCTACTTGGGAGGCTGAGGCAGGAGAATCGCTTGAA

CCCAGGAGGTGGAGGTTGCAGTAAGCTGAGATCGTGCCGTTGCACTCCAGCCTGGGCGACAA

GAGCAAGACTCTGTCTCAGAAAAAAAAAAAAAAAAAGAGAGAGAGAGAGAAAGAGAACAATAT

-continued

```
TTGGGAGAGAAGGATGGGGAAGCATTGCAAGGAAATTGTGCTTTATCCAACAAAATGTAAGG
AGCCAATAAGGGATCCCTATTTGTCTCTTTTGGTGTCTATTTGTCCCTAACAACTGTCTTTG
ACAGTGAGAAAAATATTCAGAATAACCATATCCCTGTGCCGTTATTACCTAGCAACCCTTGC
AATGAAGATGAGCAGATCCACAGGAAAACTTGAATGCACAACTGTCTTATTTTAATCTTATT
GTACATAAGTTTGTAAAAGAGTTAAAAATTGTTACTTCATGTATTCATTTATATTTTATATT
ATTTTGCGTCTAATGATTTTTTATTAACATGATTTCCTTTTCTGATATATTGAAATGGAGTC
TCAAAGCTTCATAAATTTATAACTTTAGAAATGATTCTAATAACAACGTATGTAATTGTAAC
ATTGCAGTAATGGTGCTACGAAGCCATTTCTCTTGATTTTTAGTAAACTTTTATGACAGCAA
ATTTGCTTCTGGCTCACTTTCAATCAGTTAAATAAATGATAAATAATTTTGGAAGCTGTGAA
GATAAAATACCAAATAAAATAATATAAAAGTGATTTATATGAAGTTAAAATAAAAAATCAGT
ATGATGGAATAAACTTG
```

Other exemplary deaminases that can be fused to Cas9 according to aspects of this disclosure are provided below. In embodiments, the deaminases are activation-induced deaminases (AID). It should be understood that, in some embodiments, the active domain of the respective sequence can be used, e.g., the domain without a localizing signal (nuclear localization sequence, without nuclear export signal, cytoplasmic localizing signal).

Human AID:

(SEQ ID NO: 23)

<u>MDSLLMNRRKFLYQFKNVRWAKGRRETYLC</u>YVVKRRDSATSFSLDFGYLRNKNGCHVELLFL
RYISDWDLDPGRCYRVTWFTSWSPCYDCARHVADFLRGNPNLSLRIFTARLYFCEDRKAEPE
GLRRLHRAGVQIAIMTFKDYFYCWNTFVENHERTFKAWEGLHENSVRLSRQLRRILLP<u>LYEV
DDLRDAFRTLGL</u> (underline: nuclear localization sequence; double
underline: nuclear export signal)

Mouse AID:

(SEQ ID NO: 20)

<u>MDSLLMKQKKFLYHFKNVRWAKGRHETYLC</u>YVVKRRDSATSCSLDFGHLRNKSGCHVELLFL
RYISDWDLDPGRCYRVTWFTSWSPCYDCARHVAEFLRWNPNLSLRIFTARLYFCEDRKAEPE
GLRRLHRAGVQIGIMTFKDYFYCWNTFVENRERTFKAWEGLHENSVRLTROLRRILLP<u>LYEV
DDLRDAFRMLGE</u> (underline: nuclear localization sequence; double
underline: nuclear export signal)

Canine AID:

(SEQ ID NO: 24)

<u>MDSLLMKQRKFLYHFKNVRWAKGRHETYLC</u>YVVKRRDSATSFSLDFGHLRNKSGCHVELLFL
RYISDWDLDPGRCYRVTWFTSWSPCYDCARHVADFLRGYPNLSLRI FAARLYFCEDRKAEPE
GLRRLHRAGVQIAIMTFKDYFYCWNTFVENREKTFKAWEGLHENSVRLSRQLRRILLP<u>LYEV
DDLRDAFRTLGL</u> (underline: nuclear localization sequence; double
underline: nuclear export signal)

Bovine AID:

(SEQ ID NO: 25)

<u>MDSLLKKQRQFLYQFKNVRWAKGRHETYLC</u>YVVKRRDSPTSFSLDFGHLRNKAGCHVELLFL
RYISDWDLDPGRCYRVTWFTSWSPCYDCARHVADFLRGYPNLSLRIFTARLYFCDKERKAEP
EGLRRLHRAGVQIAIMTFKDYFYCWNTFVENHERTFKAWEGLHENSVRLSRQLRRILLP<u>LYE
VDDLRDAFRTLGL</u> (underline: nuclear localization sequence;
double underline: nuclear export signal)

-continued

Rat AID:

(SEQ ID NO: 262)

MAVGSKPKAALVGPHWERERIWCFLCSTGLGTQQTGQTSRWLRPAATQDPVSPPRSLLMKQR

KFLYHFKNVRWAKGRHETYLCYVVKRRDSATSFSLDFGYLRNKSGCHVELLFLRYISDWDLD

PGRCYRVTWFTSWSPCYDCARHVADFLRGNPNLSLRIFTARLTGWGALPAGLMSPARPSDYF

YCWNTFVENHERTFKAWEGLHENSVRLSRRLRRILLPLYEVDDLRDAFRTLGL (underline: nuclear localization sequence; double underline: nuclear export signal)

clAID (*Canis lupus familiaris*):

(SEQ ID NO: 24)

MDSLLMKQRKFLYHFKNVRWAKGRHETYLCYVVKRRDSATSFSLDFGHLRNKSGCHVELLFLRYISDW

DLDPGRCYRVTWFTSWSPCYDCARHVADFLRGYPNLSLRIFAARLYFCEDRKAEPEGLRRLHRAGVQI

AIMTFKDYFYCWNTFVENREKTFKAWEGLHENSVRLSRQLRRILLPLYEVDDLRDAFRTLGL btAID (*Bos Taurus*):

(SEQ ID NO: 25)

MDSLLKKQRQFLYQFKNVRWAKGRHETYLCYVVKRRDSPTSFSLDFGHLRNKAGCHVELLFLRYISDW

DLDPGRCYRVTWFTSWSPCYDCARHVADFLRGYPNLSLRIFTARLYFCDKERKAEPEGLRRLHRAGVQ

IAIMTFKDYFYCWNTFVENHERTFKAWEGLHENSVRLSRQLRRILLPLYEVDDLRDAFRTLGL mAID (*Mus musculus*):

(SEQ ID NO: 263)

MDSLLMNRRKFLYQFKNVRWAKGRRETYLCYVVKRRDSATSFSLDFGYLRNKNGCHVELLFLRYISDW

DLDPGRCYRVTWFTSWSPCYDCARHVADFLRGNPNLSLRIFTARLYFCEDRKAEPEGLRRLHRAGVQI

AIMTFKDYFYCWNTFVENHERTFKAWEGLHENSVRLSRQLRRILLPLYEVDDLRDAFRTLGL rAPOBEC-1 (*Rattus norvegicus*):

(SEQ ID NO: 1)

MSSETGPVAVDPTLRRRIEPHEFEVFFDPRELRKETCLLYEINWGGRHSIWRHTSQNTNKHVEVNFIE

KFTTERYFCPNTRCSITWFLSWSPCGECSRAITEFLSRYPHVTLFIYIARLYHHADPRNRQGLRDLIS

SGVTIQIMTEQESGYCWRNFVNYSPSNEAHWPRYPHLWVRLYVLELYCIILGLPPCLNILRRKQPQLT

FFTIALQSCHYQRLPPHILWATGLK maAPOBEC-1 (*Mesocricetus auratus*):

(SEQ ID NO: 3)

MSSETGPVVVDPTLRRRIEPHEFDAFFDQGELRKETCLLYEIRWGGRHNIWRHTGQNTSRHVEINFIE

KFTSERYFYPSTRCSIVWFLSWSPCGECSKAITEFLSGHPNVTLFIYAARLYHHTDORNRQGLRDLIS

RGVTIRIMTEQEYCYCWRNFVNYPPSNEVYWPRYPNLWMRLYALELYCIHLGLPPCLKIKRRHQYPLT

FFRLNLOSCHYQRIPPHILWATGFI ppAPOBEC-1 (*Pongo pygmaeus*):

(SEQ ID NO: 5)

MTSEKGPSTGDPTLRRRIESWEFDVFYDPRELRKETCLLYEIKWGMSRKIWRSSGKNTINHVEVNFIK

KFTSERRFHSSISCSITWFLSWSPCWECSQAIREFLSQHPGVTLVIYVARLFWHMDQRNRQGLRDLVN

SGVTIQIMRASEYYHCWRNFVNYPPGDEAHWPQYPPLWMMLYALELHCIILSLPPCLKISRRWQNHLA

FFRLHLONCHYQTIPPHILLATGLIHPSVTWR oCAPOBEC1 (*Oryctolagus cuniculus*):

(SEQ ID NO: 6)

MASEKGPSNKDYTLRRRIEPWEFEVFFDPQELRKEACLLYEIKWGASSKTWRSSGKNTTNHVEVNFLE

KLTSEGRLGPSTCCSITWFLSWSPCWECSMAIREFLSQHPGVTLIIFVARLFQHMDRRNRQGLKDLVT

SGVTVRVMSVSEYCYCWENFVNYPPGKAAQWPRYPPRWMLMYALELYCIILGLPPCLKISRRHQKOLT

FFSLTPQYCHYKMIPPYILLATGLLQPSVPWR

-continued mdAPOBEC-1 (*Monodelphis domestica*):

(SEQ ID NO: 7)

MNSKTGPSVGDATLRRRIKPWEFVAFFNPQELRKETCLLYEIKWGNONIWRHSNQNTSQHAEINFMEK

FTAERHFNSSVRCSITWFLSWSPCWECSKAIRKFLDHYPNVTLAIFISRLYWHMDQQHRQGLKELVHS

GVTIQIMSYSEYHYCWRNFVDYPQGEEDYWPKYPYLWIMLYVLELHCIILGLPPCLKISGSHSNQLAL

FSLDLQDCHYQKIPYNVLVATGLVQPFVTWR ppAPOBEC-2 (*Pongo pygmaeus*):

(SEQ ID NO: 10)

MAQKEEAAAATEAASQNGEDLENLDDPEKLKELIELPPFEIVTGERLPANFFKFQFRNVEYSSGRNKT

FLCYVVEAQGKGGQVQASRGYLEDEHAAAHAEEAFFNTILPAFDPALRYNVTWYVSSSPCAACADRII

KTLSKTKNLRLLILVGRLFMWEELEIQDALKKLKEAGCKLRIMKPQDFEYVWQNFVEQEEGESKAFQP

WEDIQENFLYYEEKLADILK btAPOBEC-2 (*Bos Taurus*):

(SEQ ID NO: 11)

MAQKEEAAAAAEPASQNGEEVENLEDPEKLKELIELPPFEIVTGERLPAHYFKFQFRNVEYSSGRNKT

FLCYVVEAQSKGGQVQASRGYLEDEHATNHAEEAFFNSIMPTFDPALRYMVTWYVSSSPCAACADRIV

KTLNKTKNLRLLILVGRLFMWEEPEIQAALRKLKEAGCRLRIMKPQDFEYIWQNFVEQEEGESKAFEP

WEDIQENFLYYEEKLADILK mAPOBEC-3-(1) (*Mus musculus*):

(SEQ ID NO: 12)

MQPQRLGPRAGMGPFCLGCSHRKCYSPIRNLISQETFKFHFKNLGYAKGRKDTFLCYEVTRKDCDSPV

SLHHGVFKNKDNIHAEICFLYWFHDKVLKVLSPREEFKITWYMSWSPCFECAEQIVRFLATHHNLSLD

IFSSRLYNVQDPETQQNLCRLVQEGAQVAAMDLYEFKKCWKKFVDNGGRRFRPWKRLLTNFRYQDSKL

QEILRPCYISVPSSSSSTLSNICLTKGLPETRFWVEGRRMDPLSEEEFYSQFYNQRVKHLCYYHRMKP

YLCYQLEQFNGQAPLKGCLLSEKGKQHAEILFLDKIRSMELSQVTITCYLTWSPCPNCAWQLAAFKRD

RPDLILHIYTSRLYFHWKRPFQKGLCSLWQSGILVDVMDLPQFTDCWTNFVNPKRPFWPWKGLEIISR

RTQRRLRRIKESWGLQDLVNDFGNLQLGPPMS

Mouse APOBEC-3-(2):

(SEQ ID NO: 264)

MGPFCLGCSHRKCYSPIRNLISQETFKFHFKNLGYAKGRKDTFLCYEVTRKDCDSPVSLHHGVFKNKD

NIHAEICFLYWFHDKVLKVLSPREEFKITWYMSWSPCFECAEQIVRFLATHHNLSLDIFSSRLYNVQD

PETQQNLCRLVQEGAQVAAMDLYEFKKCWKKFVDNGGRRFRPWKRLLTNFRYQDSKLQEILRPCYIPV

PSSSSSTLSNICLTKGLPETRFCVEGRRMDPLSEEEFYSQFYNQRVKHLCYYHRMKPYLCYQLEQFNG

QAPLKGCLLSEKGKQHAEILFLDKIRSMELSQVTITCYLTWSPCPNCAWQLAAFKRDRPDLILHIYTS

RLYFHWKRPFQKGLCSLWQSGILVDVMDLPQFTDCWTNFVNPKRPFWPWKGLEIISRRTQRRLRRIKE

SWGLQDLVNDFGNLQLGPPMS (italic: nucleic acid editing domain)

Rat APOBEC-3:

(SEQ ID NO: 265)

MGPFCLGCSHRKCYSPIRNLISQETFKFHFKNRLRYAIDRKDTFLCYEVTRKDCDSPVSLHHGVFKNK

DNIHAEICFLYWFHDKVLKVLSPREEFKITWYMSWSPCFECAEQVLRFLATHHNLSLDIFSSRLYNIR

DPENQQNLCRLVQEGAQVAAMDLYEFKKCWKKFVDNGGRRFRPWKKLLTNFRYQDSKLQEILRPCYIP

VPSSSSSTLSNICLTKGLPETRFCVERRRVHLLSEEEFYSQFYNQRVKHLCYYHGVKPYLCYQLEQFN

GQAPLKGCLLSEKGKQHAEILFLDKIRSMELSQVIITCYLTWSPCPNCAWQLAAFKRDRPDLILHIYT

SRLYFHWKRPFQKGLCSLWQSGILVDVMDLPQFTDCWTNFVNPKRPFWPWKGLEIISRRTQRRLHRIK

ESWGLQDLVNDFGNLQLGPPMS (italic: nucleic acid editing domain)

-continued hAPOBEC-3A (*Homo sapiens*):

(SEQ ID NO: 13)

MEASPASGPRHLMDPHIFTSNFNNGIGRHKTYLCYEVERLDNGTSVKMDQHRGFLHNQAKNLLCGFYG

RHAELRFLDLVPSLQLDPAQIYRVTWFISWSPCFSWGCAGEVRAFLQENTHVRLRIFAARIYDYDPLY

KEALQMLRDAGAQVSIMTYDEFKHCWDTFVDHQGCPFQPWDGLDEHSQALSGRLRAILQNQGN hAPOBEC-3F (*Homo sapiens*):

(SEQ ID NO: 17)

MKPHFRNTVERMYRDTFSYNFYNRPILSRRNTVWLCYEVKTKGPSRPRLDAKIFRGQVYSQPEHHAEM

CFLSWFCGNQLPAYKCFQITWFVSWTPCPDCVAKLAEFLAEHPNVTLTISAARLYYYWERDYRRALCR

LSQAGARVKIMDDEEFAYCWENFVYSEGQPFMPWYKFDDNYAFLHRTLKEILRNPMEAMYPHIFYFHF

KNLRKAYGRNESWLCFTMEVVKHHSPVSWKRGVFRNQVDPETHCHAERCFLSWFCDDILSPNTNYEVT

WYTSWSPCPECAGEVAEFLARHSNVNLTIFTARLYYFWDTDYQEGLRSLSQEGASVEIMGYKDFKYCW

ENFVYNDDEPFKPWKGLKYNFLFLDSKLQEILE

*Rhesus macaque* APOBEC-3G:

(SEQ ID NO: 266)

MVEPMDPRTFVSNFNNRPILSGLNTVWLCCEVKTKDPSGPPLDAKIFQGKVYSKAKYHPEMRFLRWFH

KWRQLHHDQEYKVTWYVSWSPCTRCANSVATFLAKDPKVTLTIFVARLYYFWKPDYQQALRILCQKRG

GPHATMKIMNYNEFQDCWNKFVDGRGKPFKPRNNLPKHYTLLQATLGELLRHLMDPGTFTSNFNNKPW

VSGQHETYLCYKVERLHNDTWVPLNQHRGFLRNQAPNIHGFPKGRHAELCFLDLIPFWKLDGQQYRVT

CFTSWSPCFSCAQEMAKFISNNEHVSLCIFAARIYDDQGRYQEGLRALHRDGAKIAMMNYSEFEYCWD

TFVDRQGRPFQPWDGLDEHSQALSGRLRAI (italic: nucleic acid editing domain; underline: cytoplasmic localization signal)

Chimpanzee APOBEC-3G:

(SEQ ID NO: 267)

MKPHFRNPVERMYQDTFSDNFYNRPILSHRNTVWLCYEVKTKGPSRPPLDAKIFRGQVYSKLKY*HPEM*

*RFFHWFSKWRKLHRDQEYEVTWYISWSPCTKC*TRDVATFLAEDPKVTLTIFVARLYYFWDPDYQEALR

SLCQKRDGPRATMKIMNYDEFQHCWSKFVYSQRELFEPWNNLPKYYILLHIMLGEILRHSMDPPTFTS

NFNNELWVRGRHETYLCYEVERLHNDTWVLLNQRRGFLCNQAPHKHGFLEGR*HAELCFLDVIPFWKLD*

*LHQDYRVTCFTSWSPCFSC*AQEMAKFISNNKHVSLCIFAARIYDDQGRCQEGLRTLAKAGAKISIMTY

SEFKHCWDTFVDHQGCPFQPWDGLEEHSQALSGRLRAILQNQGN (italic: nucleic acid editing domain; underline: cytoplasmic localization signal)

Green monkey APOBEC-3G:

(SEQ ID NO: 268)

MNPQIRNMVEQMEPDIFVYYFNNRPILSGRNTVWLCYEVKTKDPSGPPLDANIFQGKLYPEAKD*HPEM*

*KFLHWFRKWRQLHRDQEYEVTWYVSWSPCTRC*ANSVATFLAEDPKVTLTIFVARLYYFWKPDYQQALR

ILCQERGGPHATMKIMNYNEFQHCWNEFVDGQGKPFKPRKNLPKHYTLLHATLGELLRHVMDPGTFTS

NFNNKPWVSGQRETYLCYKVERSHNDTWVLLNQHRGFLRNQAPDRHGFPKGRHAEL*CFLDLIPFWKLD*

*DQQYRVTCFTSWSPCFSC*AQKMAKFISNNKHVSLCIFAARIYDDQGRCQEGLRTLHRDGAKIAVMNYS

EFEYCWDTFVDROGRPFQPWDGLDEHSQALSGRLRAI (italic: nucleic acid editing domain; underline: cytoplasmic localization signal)

Human APOBEC-3G:

(SEQ ID NO: 18)

MKPHFRNTVERMYRDTFSYNFYNRPILSRRNTVWLCYEVKTKGPSRPPLDAKIFRGQVYSELKY*HPEM*

*RFFHWFSKWRKLHRDQEYEVTWYISWSPCTKC*TRDMATFLAEDPKVTLTIFVARLYYFWDPDYQEALR

SLCQKRDGPRATMKIMNYDEFQHCWSKFVYSQRELFEPWNNLPKYYILLHIMLGEILRHSMDPPTFTF

-continued

NFNNEPWVRGRHETYLCYEVERMHNDTWVLLNQRRGFLCNQAPHKHGFLEGR*HAELCFLDVIPFWKLD*

*LDQDYRVTCFTSWSPCFSC*AQEMAKFISKNKHVSLCIFTARIYDDQGRCQEGLRTLAEAGAKISIMTY

SEFKHCWDTFVDHQGCPFQPWDGLDEHSQDLSGRLRAILQNQEN (italic: nucleic acid editing domain; underline: cytoplasmic localization signal)

Human APOBEC-3F:

(SEQ ID NO: 17)

MKPHFRNTVERMYRDTFSYNFYNRPILSRRNTVWLCYEVKTKGPSRPRLDAKIFRGQVYSQPEH*HAEM*

*CFLSWFCGNQLPAYKCFQITWFVSWTPCPDC*VAKLAEFLAEHPNVTLTISAARLYYYWERDYRRALCR

LSQAGARVKIMDDEEFAYCWENFVYSEGQPFMPWYKFDDNYAFLHRTLKEILRNPMEAMYPHIFYFHF

KNLRKAYGRNESWLCFTMEVVKHHSPVSWKRGVFRNQVDPETH*CHAERCFLSWFCDDILSPNTNYEVT*

*WYTSWSPCPEC*AGEVAEFLARHSNVNLTIFTARLYYFWDTDYQEGLRSLSQEGASVEIMGYKDFKYCW

ENFVYNDDEPFKPWKGLKYNFLFLDSKLQEILE (italic: nucleic acid editing domain)

Human APOBEC-3B:

(SEQ ID NO: 14)

MNPQIRNPMERMYRDTFYDNFENEPILYGRSYTWLCYEVKIKRGRSNLLWDTGVFRGQVYFKPQY*HAE*

*MCFLSWFCGNQLPAYKCFQITWFVSWTPCPDC*VAKLAEFLSEHPNVTLTISAARLYYYWERDYRRALC

RLSQAGARVTIMDYEEFAYCWENFVYNEGQQFMPWYKFDENYAFLHRTLKEILRYLMDPDTFTFNFNN

DPLVLRRRQTYLCYEVERLDNGTWVLMDQHMGFLCNEAKNLLCGFY*GRHAELRFLDLVPSLQLDPAQI*

*YRVTWFISWSPCFSWGC*AGEVRAFLQENTHVRLRIFAARIYDYDPLYKEALQMLRDAGAQVSIMTYDE

FEYCWDTFVYRQGCPFQPWDGLEEHSQALSGRLRAILQNQGN (italic: nucleic acid editing domain)

Rat APOBEC-3B:

(SEQ ID NO: 269)

MQPQGLGPNAGMGPVCLGCSHRRPYSPIRNPLKKLYQQTFYFHFKNVRYAWGRKNNFLCYEVNGMDCA

LPVPLRQGVFRKQGHIHAELCFIYWFHDKVLRVLSPMEEFKVTWYMSWSPCSKCAEQVARFLAAHRNL

SLAIFSSRLYYYLRNPNYQQKLCRLIQEGVHVAAMDLPEFKKCWNKFVDNDGQPFRPWMRLRINFSFY

DCKLQEIFSRMNLLREDVFYLQFNNSHRVKPVQNRYYRRKSYLCYQLERANGQEPLKGYLLYKKGEQH

VEILFLEKMRSMELSQVRITCYLTWSPCPNCARQLAAFKKDHPDLILRIYTSRLYFWRKKFQKGLCTL

WRSGIHVDVMDLPQFADCWTNFVNPQRPFRPWNELEKNSWRIQRRLRRIKESWGL

Bovine APOBEC-3B:

(SEQ ID NO: 270)

DGWEVAFRSGTVLKAGVLGVSMTEGWAGSGHPGQGACVWTPGTRNTMNLLREVLFKQQFGNQPRVPAP

YYRRKTYLCYQLKQRNDLTLDRGCFRNKKQRHAERFIDKINSLDLNPSQSYKIICYITWSPCPNCANE

LVNFITRNNHLKLEIFASRLYFHWIKSFKMGLQDLQNAGISVAVMTHTEFEDCWEQFVDNQSRPFQPW

DKLEQYSASIRRRLQRILTAPI

Chimpanzee APOBEC-3B:

(SEQ ID NO: 271)

MNPQIRNPMEWMYQRTFYYNFENEPILYGRSYTWLCYEVKIRRGHSNLLWDTGVFRGQMYSQPEHHAE

MCFLSWFCGNQLSAYKCFQITWFVSWTPCPDCVAKLAKFLAEHPNVTLTISAARLYYYWERDYRRALC

RLSQAGARVKIMDDEEFAYCWENFVYNEGQPFMPWYKFDDNYAFLHRTLKEIIRHLMDPDTFTFNENN

DPLVLRRHQTYLCYEVERLDNGTWVLMDQHMGFLCNEAKNLLCGFYGRHAELRFLDLVPSLQLDPAQI

YRVTWFISWSPCFSWGCAGQVRAFLQENTHVRLRIFAARIYDYDPLYKEALQMLRDAGAQVSIMTYDE

FEYCWDTFVYRQGCPFQPWDGLEEHSQALSGRLRAILQVRASSLCMVPHRPPPPPQSPGPCLPLCSEP

PLGSLLPTGRPAPSLPFLLTASFSFPPPASLPPLPSLSLSPGHLPVPSFHSLTSCSIQPPCSSRIRET

EGWASVSKEGRDLG

-continued

Human APOBEC-3C:

(SEQ ID NO: 15)

MNPQIRNPMKAMYPGTFYFQFKNLWEANDRNETWLCFTVEGIKRRSVVSWKTGVFRNQVDSETH*CHAE*

*RCFLSWFCDDILSPNTKYQVTWYTSWSPCPDC*AGEVAEFLARHSNVNLTIFTARLYYFQYPCYQEGLR

SLSQEGVAVEIMDYEDFKYCWENFVYNDNEPFKPWKGLKTNFRLLKRRLRESLQ (italic: nucleic acid editing domain)

Gorilla APOBEC-3C (SEQ ID NO: 272)

MNPQIRNPMKAMYPGTFYFQFKNLWEANDRNETWLCFTVEGIKRRSVVSWKTGVFRNQVDSETH*CHAE*

*RCFLSWECDDILSPNTNYQVTWYTSWSPCPEC*AGEVAEFLARHSNVNLTIFTARLYYFQDTDYQEGLR

SLSQEGVAVKIMDYKDFKYCWENFVYNDDEPFKPWKGLKYNFRFLKRRLQEILE (italic: nucleic acid editing domain)

Human APOBEC-3A:

(SEQ ID NO: 13)

MEASPASGPRHLMDPHIFTSNFNNGIGRHKTYLCYEVERLDNGTSVKMDQHRGFLHNQAKNLLCGFYG

R*HAELRFLDLVPSLQLDPAQIYRVTWFISWSPCFSWGC*AGEVRAFLQENTHVRLRIFAARIYDYDPLY

KEALQMLRDAGAQVSIMTYDEFKHCWDTFVDHQGCPFQPWDGLDEHSQALSGRLRAILQNQGN (italic: nucleic acid editing domain)

*Rhesus macaque* APOBEC-3A:

(SEQ ID NO: 273)

MDGSPASRPRHLMDPNTFTFNFNNDLSVRGRHQTYLCYEVERLDNGTWVPMDERRGFLCNKAKNVPCG

DYGC*HVELRFLCEVPSWQLDPAQTYRVTWFISWSPC*FRRGCAGQVRVFLQENKHVRLRIFAARIYDYD

PLYQEALRTLRDAGAQVSIMTYEEFKHCWDTFVDRQGRPFQPWDGLDEHSQALSGRLRAILQNQGN (italic: nucleic acid editing domain)

Bovine APOBEC-3A:

(SEQ ID NO: 274)

MDEYTFTENFNNQGWPSKTYLCYEMERLDGDATIPLDEYKGFVRNKGLDQPEKPC*HAELYFLGKIHSW*

*NLDRNQHYRLTCFISWSPC*YDCAQKLTTFLKENHHISLHILASRIYTHNRFGCHQSGLCELQAAGARI

TIMTFEDFKHCWETFVDHKGKPFQPWEGLNVKSQALCTELQAILKTOON (italic: nucleic acid editing domain)

Human APOBEC-3H:

(SEQ ID NO: 275)

MALLTAETFRLQFNNKRRLRRPYYPRKALLCYQLTPQNGSTPTRGYFENKKKC*HAEICFINEIKSMGL*

*DETQCYQVTCYLTWSPCSSC*AWELVDFIKAHDHLNLGIFASRLYYHWCKPQQKGLRLLCGSQVPVEVM

GFPKFADCWENFVDHEKPLSFNPYKMLEELDKNSRAIKRRLERIKIPGVRAQGRYMDILCDAEV (italic: nucleic acid editing domain)

*Rhesus macaque* APOBEC-3H:

(SEQ ID NO: 276)

MALLTAKTFSLQFNNKRRVNKPYYPRKALLCYQLTPQNGSTPTRGHLKNKKKDHAEIRFINKIKSMGL

DETQCYQVTCYLTWSPCPSCAGELVDFIKAHRHLNLRIFASRLYYHWRPNYQEGLLLLCGSQVPVEVM

GLPEFTDCWENFVDHKEPPSFNPSEKLEELDKNSQAIKRRLERIKSRSVDVLENGLRSLQLGPVTPSS

SIRNSR

Human APOBEC-3D:

(SEQ ID NO: 16)

MNPQIRNPMERMYRDTFYDNFENEPILYGRSYTWLCYEVKIKRGRSNLLWDTGVFRGPVLPKRQSNHR

QEVYFRFENHAEMCFLSWFCGNRLPANRRFQITWFVSWNPCLPCVVKVTKFLAEHPNVTLTISAARLY

YYRDRDWRWVLLRLHKAGARVKIMDYEDFAYCWENFVCNEGQPFMPWYKFDDNYASLHRTLKEILRNP

MEAMYPHIFYFHFKNLLKACGRNESWLCFTMEVTKHHSAVFRKRGVFRNQVDPETHC*HAERCFLSWFC*

-continued

*DDILSPNTNYEVTWYTSWSPCPEC*AGEVAEFLARHSNVNLTIFTARLCYFWDTDYQEGLCSLSQEGAS

VKIMGYKDFVSCWKNFVYSDDEPFKPWKGLQTNFRLLKRRLREILQ (italic: nucleic acid editing domain)

Human APOBEC-1:

(SEQ ID NO: 4)

MTSEKGPSTGDPTLRRRIEPWEFDVFYDPRELRKEACLLYEIKWGMSRKIWRSSGKNTTNHVEVNFIK

KFTSERDFHPSMSCSITWFLSWSPCWECSQAIREFLSRHPGVTLVIYVARLFWHMDQQNRQGLRDLVN

SGVTIQIMRASEYYHCWRNFVNYPPGDEAHWPQYPPLWMMLYALELHCIILSLPPCLKISRRWQNHLT

FFRLHLQNCHYQTIPPHILLATGLIHPSVAWR

Mouse APOBEC-1:

(SEQ ID NO: 2)

MSSETGPVAVDPTLRRRIEPHEFEVFFDPRELRKETCLLYEINWGGRHSVWRHTSQNTSNHVEVNFLE

KFTTERYFRPNTRCSITWFLSWSPCGECSRAITEFLSRHPYVTLFIYIARLYHHTDQRNROGLRDLIS

SGVTIQIMTEQEYCYCWRNFVNYPPSNEAYWPRYPHLWVKLYVLELYCIILGLPPCLKILRRKQPQLT

FFTITLQTCHYQRIPPHLLWATGLK

Rat APOBEC-1:

(SEQ ID NO: 1)

MSSETGPVAVDPTLRRRIEPHEFEVFFDPRELRKETCLLYEINWGGRHSIWRHTSQNTNKHVEVNFIE

KFTTERYFCPNTRCSITWFLSWSPCGECSRAITEFLSRYPHVTLFIYIARLYHHADPRNRQGLRDLIS

SGVTIQIMTEQESGYCWRNFVNYSPSNEAHWPRYPHLWVRLYVLELYCIILGLPPCLNILRRKQPQLT

FFTIALQSCHYQRLPPHILWATGLK

Human APOBEC-2:

(SEQ ID NO: 9)

MAQKEEAAVATEAASONGEDLENLDDPEKLKELIELPPFEIVTGERLPANFFKFQFRNVEYSSGRNKT

FLCYVVEAQGKGGQVQASRGYLEDEHAAAHAEEAFFNTILPAFDPALRYNVTWYVSSSPCAACADRII

KTLSKTKNLRLLILVGRLFMWEEPEIQAALKKLKEAGCKLRIMKPQDFEYVWQNFVEQEEGESKAFQP

WEDIQENFLYYEEKLADILK

Mouse APOBEC-2:

(SEQ ID NO: 8)

MAQKEEAAEAAAPASQNGDDLENLEDPEKLKELIDLPPFEIVTGVRLPVNFFKFQFRNVEYSSGRNKT

FLCYVVEVQSKGGQAQATQGYLEDEHAGAHAEEAFFNTILPAFDPALKYNVTWYVSSSPCAACADRIL

KTLSKTKNLRLLILVSRLFMWEEPEVQAALKKLKEAGCKLRIMKPQDFEYIWQNFVEQEEGESKAFEP

WEDIQENFLYYEEKLADILK

Rat APOBEC-2:

(SEQ ID NO: 277)

MAQKEEAAEAAAPASQNGDDLENLEDPEKLKELIDLPPFEIVTGVRLPVNFFKFQFRNVEYSSGRNKT

FLCYVVEAQSKGGQVQATQGYLEDEHAGAHAEEAFFNTILPAFDPALKYNVTWYVSSSPCAACADRIL

KTLSKTKNLRLLILVSRLFMWEEPEVQAALKKLKEAGCKLRIMKPQDFEYLWQNFVEQEEGESKAFEP

WEDIQENFLYYEEKLADILK

Bovine APOBEC-2:

(SEQ ID NO: 11)

MAQKEEAAAAAEPASQNGEEVENLEDPEKLKELIELPPFEIVTGERLPAHYFKFQFRNVEYSSGRNKT

FLCYVVEAQSKGGQVQASRGYLEDEHATNHAEEAFFNSIMPTFDPALRYMVTWYVSSSPCAACADRIV

KTLNKTKNLRLLILVGRLFMWEEPEIQAALRKLKEAGCRLRIMKPQDFEYIWQNFVEQEEGESKAFEP

WEDIQENFLYYEEKLADILK

*Petromyzon marinus* CDA1 (pmCDA1):

(SEQ ID NO: 278)

MTDAEYVRIHEKLDIYTFKKQFFNNKKSVSHRCYVLFELKRRGERRACFWGYAVNKPQSGTERGIHAE

IFSIRKVEEYLRDNPGQFTINWYSSWSPCADCAEKILEWYNQELRGNGHTLKIWACKLYYEKNARNQI

-continued

GLWNLRDNGVGLNVMVSEHYQCCRKIFIQSSHNQLNENRWLEKTLKRAEKRRSELSFMIQVKILHTTK

SPAV

Human APOBEC3G D316R D317R:

(SEQ ID NO: 279)

MKPHFRNTVERMYRDTFSYNFYNRPILSRRNTVWLCYEVKTKGPSRPPLDAKIFRGQVYSELKYHPEM

RFFHWFSKWRKLHRDQEYEVTWYISWSPCTKCTRDMATFLAEDPKVTLTIFVARLYYFWDPDYQEALR

SLCQKRDGPRATMKFNYDEFQHCWSKFVYSQRELFEPWNNLPKYYILLHFMLGEILRHSMDPPTFTFN

FNNEPWVRGRHETYLCYEVERMHNDTWVLLNQRRGFLCNQAPHKHGFLEGRHAELCFLDVIPFWKLDL

DQDYRVTCFTSWSPCFSCAQEMAKFISKKHVSLCIFTARIYRRQGRCQEGLRTLAEAGAKISFTYSEF

KHCWDTFVDHQGCPFQPWDGLDEHSQDLSGRLRAILQNQEN

Human APOBEC3G chain A:

(SEQ ID NO: 280)

MDPPTFTFNFNNEPWWGRHETYLCYEVERMHNDTWVLLNORRGFLCNQAPHKHGFLEGRHAELCFLDV

IPFWKLDLDQDYRVTCFTSWSPCFSCAQEMAKFISKNKHVSLCIFTARIYDDQGRCQEGLRTLAEAGA

KISFTYSEFKHCWDTFVDHQGCPFQPWDGLDEHSQDLSGRLRAILQ

Human APOBEC3G chain A D120R D121R:

(SEQ ID NO: 281)

MDPPTFTFNFNNEPWVRGRHETYLCYEVERMINDTWVLLNORRGFLCNQAPHKHGFLEGRHAELCFLD

VIPFWKLDLDQDYRVTCFTSWSPCFSCAQEMAKFISKNKHVSLCIFTARIYRRQGRCQEGLRTLAEAG

AKISFMTYSEFKHCWDTFVDHQGCPFQPWDGLDEHSQDLSGRLRAILQ hAPOBEC-4 (*Homo sapiens*):

(SEQ ID NO: 19)

MEPIYEEYLANHGTIVKPYYWLSFSLDCSNCPYHIRTGEEARVSLTEFCQIFGFPYGTTFPQTKHLTF

YELKTSSGSLVQKGHASSCTGNYIHPESMLFEMNGYLDSAIYNNDSIRHIILYSNNSPCNEANHCCIS

KMYNFLITYPGITLSIYFSQLYHTEMDFPASAWNREALRSLASLWPRVVLSPISGGIWHSVLHSFISG

VSGSHVFQPILTGRALADRHNAYEINAITGVKPYFTDVLLQTKRNPNTKAQEALESYPLNNAFPGOFF

QMPSGQLQPNLPPDLRAPVVFVLVPLRDLPPMHMGQNPNKPRNIVRHLNMPQMSFQETKDLGRLPTGR

SVEIVEITEQFASSKEADEKKKKKGKK mAPOBEC-4 (*Mus musculus*):

(SEQ ID NO: 20)

MDSLLMKQKKFLYHFKNVRWAKGRHETYLCYVVKRRDSATSCSLDFGHLRNKSGCHVELLFLRYISDW

DLDPGRCYRVTWFTSWSPCYDCARHVAEFLRWNPNLSLRIFTARLYFCEDRKAEPEGLRRLHRAGVQI

GIMTFKDYFYCWNTFVENRERTFKAWEGLHENSVRLTRQLRRILLPLYEVDDLRDAFRMLGF rAPOBEC-4 (*Rattus norvegicus*):

(SEQ ID NO: 21)

MEPLYEEYLTHSGTIVKPYYWLSVSLNCTNCPYHIRTGEEARVPYTEFHQTFGFPWSTYPQTKHLTFY

ELRSSSGNLIQKGLASNCTGSHTHPESMLFERDGYLDSLIFHDSNIRHIILYSNNSPCDEANHCCISK

MYNFLMNYPEVTLSVFFSQLYHTENQFPTSAWNREALRGLASLWPQVTLSAISGGIWQSILETFVSGI

SEGLTAVRPFTAGRTLTDRYNAYEINCITEVKPYFTDALHSWQKENQDQKVWAASENQPLHNTTPAQW

QPDMSQDCRTPAVFMLVPYRDLPPIHVNPSPQKPRTVVRHLNTLQLSASKVKALRKSPSGRPVKKEEA

RKGSTRSQEANETNKSKWKKQTLFIKSNICHLLEREQKKIGILSSWSV mfAPOBEC-4 (*Macaca fascicularis*):

(SEQ ID NO: 22)

MEPTYEEYLANHGTIVKPYYWLSFSLDCSNCPYHIRTGEEARVSLTEFCQIFGFPYGTTYPQTKHLTF

YELKTSSGSLVQKGHASSCTGNYIHPESMLFEMNGYLDSAIYNNDSIRHIILYCNNSPCNEANHCCIS

KVYNFLITYPGITLSIYFSQLYHTEMDFPASAWNREALRSLASLWPRVVLSPISGGIWHSVLHSFVSG

VSGSHVFQPILTGRALTDRYNAYEINAITGVKPFFTDVLLHTKRNPNTKAQMALESYPLNNAFPGQSF

-continued

QMTSGIPPDLRAPVVFVLLPLRDLPPMHMGQDPNKPRNIIRHLNMPQMSFQETKDLERLPTRRSVETV

EITERFASSKQAEEKTKKKKGKK pmCDA-1 (*Petromyzon marinus*):

(SEQ ID NO: 27)

MAGYECVRVSEKLDFDTFEFQFENLHYATERHRTYVIFDVKPQSAGGRSRRLWGYIINNPNVCHAELI

LMSMIDRHLESNPGVYAMTWYMSWSPCANCSSKLNPWLKNLLEEQGHTLTMHFSRIYDRDREGDHRGL

RGLKHVSNSFRMGVVGRAEVKECLAEYVEASRRTLTWLDTTESMAAKMRRKLFCILVRCAGMRESGIP

LHLFTLQTPLLSGRVVWWRV pmCDA-2 (*Petromyzon marinus*):

(SEQ ID NO: 28)

MELREVVDCALASCVRHEPLSRVAFLRCFAAPSQKPRGTVILFYVEGAGRGVTGGHAVNYNKQGTSIH

AEVLLLSAVRAALLRRRRCEDGEEATRGCTLHCYSTYSPCRDCVEYIQEFGASTGVRVVIHCCRLYEL

DVNRRRSEAEGVLRSLSRLGRDFRLMGPRDAIALLLGGRLANTADGESGASGNAWVTETNVVEPLVDM

TGFGDEDLHAQVQRNKQIREAYANYASAVSLMLGELHVDPDKFPFLAEFLAQTSVEPSGTPRETRGRP

RGASSRGPEIGRQRPADFERALGAYGLFLHPRIVSREADREEIKRDLIVVMRKHNYQGP pmCDA-5 (*Petromyzon marinus*):

(SEQ ID NO: 29)

MAGDENVRVSEKLDFDTFEFQFENLHYATERHRTYVIFDVKPQSAGGRSRRLWGYIINNPNVCHAELI

LMSMIDRHLESNPGVYAMTWYMSWSPCANCSSKLNPWLKNLLEEQGHTLMMHFSRIYDRDREGDHRGL

RGLKHVSNSFRMGVVGRAEVKECLAEYVEASRRTLTWLDTTESMAAKMRRKLFCILVRCAGMRESGMP

LHLFT yCD (*Saccharomyces cerevisiae*):

(SEQ ID NO: 30)

MVTGGMASKWDQKGMDIAYEEAALGYKEGGVPIGGCLINNKDGSVLGRGHNMRFQKGSATLHGEISTL

ENCGRLEGKVYKDTTLYTTLSPCDMCTGAIIMYGIPRCVVGENVNFKSKGEKYLQTRGHEVVVVDDER

CKKIMKQFIDERPQDWFEDIGE rAPOBEC-1 (delta 177-186):

(SEQ ID NO: 282)

MSSETGPVAVDPTLRRRIEPHEFEVFFDPRELRKETCLLYEINWGGRHSIWRHTSQNTNKHVEVNFIE

KFTTERYFCPNTRCSITWFLSWSPCGECSRAITEFLSRYPHVTLFIYIARLYHHADPRNROGLRDLIS

SGVTIQIMTEQESGYCWRNFVNYSPSNEAHWPRYPHLWVRGLPPCLNILRRKQPQLTFFTIALQSCHY

QRLPPHILWATGLK rAPOBEC-1 (delta 202-213):

(SEQ ID NO: 283)

MSSETGPVAVDPTLRRRIEPHEFEVFFDPRELRKETCLLYEINWGGRHSIWRHTSQNTNKHVEVNFIE

KFTTERYFCPNTRCSITWFLSWSPCGECSRAITEFLSRYPHVTLFIYIARLYHHADPRNRQGLRDLIS

SGVTIQIMTEQESGYCWRNFVNYSPSNEAHWPRYPHLWVRLYVLELYCIILGLPPCLNILRRKQPQHY

QRLPPHILWATGLK

Mouse APOBEC-3:

(SEQ ID NO: 264)

MGPFCLGCSHRKCYSPIRNLISQETFKFHFKNLGYAKGRKDTFLCYEVTRKDCDSPVSLHHG

VFKNKDNI*HAEICFLYWFHDKVLKVLSPREEFKITWYMSWSPCFEC*AEQIVRFLATHHNLSL

DIFSSRLYNVQDPETQQNLCRLVQEGAQVAAMDLYEFKKCWKKFVDNGGRRFRPWKRLLTNF

RYQDSKLQEILRPCYIPVPSSSSSTLSNICLTKGLPETRFCVEGRRMDPLSEEEFYSQFYNQ

RVKHLCYYHRMKPYLCYQLEQFNGQAPLKGCLLSEKGKQ*HAEILFLDKIRSMELSQVTITCY*

-continued

*LTWSPCPNC*AWQLAAFKRDRPDLILHIYTSRLYFHWKRPFQKGLCSLWQSGILVDVMDLPQF

TDCWTNFVNPKRPFWPWKGLEIISRRTQRRLRRIKESWGLQDLVNDFGNLQLGPPMS (italic: nucleic acid editing domain)

Some aspects of the present disclosure are based on the recognition that modulating the deaminase domain catalytic activity of any of the fusion proteins described herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deamination window can prevent unwanted deamination of residues adjacent to specific target residues, which can decrease or prevent off-target effects.

In some embodiments, an APOBEC deaminase incorporated into a base editor can comprise one or more mutations selected from the group consisting of R15X, R16X, H21X, R30X, R33X, K34X, R52X, K60X, R118X, H121X, H122X, R126X, R128X, R169X, R198X, T36X, H53X, V62X, L88X, W90X, Y120X and R132X of rAPOBEC1, or one or more corresponding mutations in another APOBEC deaminase, wherein X is any amino acid. In some embodiments, an APOBEC deaminase incorporated into a base editor can comprise one or more mutations selected from the group consisting of R15A, R16A, H21A, R30A, R33A, K34A, R52A, K60A, R118A, H121A, H122A, H122L, R126A, R128A, R169A, R198A, T36A, H53A, V62A, L88A, W90F, W90A, Y120F, Y120A, H121R, H122R, R126E, W90Y, and R132E of rAPOBEC1, or one or more corresponding mutations in another APOBEC deaminase. In some embodiments, an APOBEC deaminase incorporated into a base editor comprises a combination of mutations selected from the group consisting of K34A+R33A, K34A+H122A, K34A+Y120F, K34A+R52A, K34A+H122A, K34A+H121A, W90A+R126E, W90Y+R126E, H121R+H122R, R126+R132E, W90Y+R132E, and W90Y+R126E+R132E of rAPOBEC1, or a combination of corresponding mutations in another APOBEC deaminase.

In some embodiments an APOBEC deaminase incorporated into a base editor can comprise an APOBEC deaminase comprising a R15A mutation of rAPOBEC1, or one or more corresponding mutations in another APOBEC deaminase. In some embodiments an APOBEC deaminase incorporated into a base editor can comprise an APOBEC deaminase comprising a R16A mutation of rAPOBEC1, or one or more corresponding mutations in another APOBEC deaminase. In some embodiments an APOBEC deaminase incorporated into a base editor can comprise an APOBEC deaminase comprising a H21A mutation of rAPOBEC1, or one or more corresponding mutations in another APOBEC deaminase. In some embodiments an APOBEC deaminase incorporated into a base editor can comprise an APOBEC deaminase comprising a R30A mutation of rAPOBEC1, or one or more corresponding mutations in another APOBEC deaminase. In some embodiments an APOBEC deaminase incorporated into a base editor can comprise an APOBEC deaminase comprising a R33A mutation of rAPOBEC1, or one or more corresponding mutations in another APOBEC deaminase. In some embodiments an APOBEC deaminase incorporated into a base editor can comprise an APOBEC deaminase comprising a K34A mutation of rAPOBEC1, or one or more corresponding mutations in another APOBEC deaminase. In some embodiments an APOBEC deaminase incorporated into a base editor can comprise an APOBEC deaminase comprising a R52A mutation of rAPOBEC1, or one or more corresponding mutations in another APOBEC deaminase. In some embodiments an APOBEC deaminase incorporated into a base editor can comprise an APOBEC deaminase comprising a R60A mutation of rAPOBEC1, or one or more corresponding mutations in another APOBEC deaminase. In some embodiments an APOBEC deaminase incorporated into a base editor can comprise an APOBEC deaminase comprising a H121A mutation of rAPOBEC1, or one or more corresponding mutations in another APOBEC deaminase. In some embodiments an APOBEC deaminase incorporated into a base editor can comprise an APOBEC deaminase comprising a H122A mutation of rAPOBEC1, or one or more corresponding mutations in another APOBEC deaminase. In some embodiments an APOBEC deaminase incorporated into a base editor can comprise an APOBEC deaminase comprising a H122L mutation of rAPOBEC1, or one or more corresponding mutations in another APOBEC deaminase. In some embodiments an APOBEC deaminase incorporated into a base editor can comprise an APOBEC deaminase comprising a R128A mutation of rAPOBEC1, or one or more corresponding mutations in another APOBEC deaminase. In some embodiments an APOBEC deaminase incorporated into a base editor can comprise an APOBEC deaminase comprising a R169A mutation of rAPOBEC1, or one or more corresponding mutations in another APOBEC deaminase. In some embodiments an APOBEC deaminase incorporated into a base editor can comprise an APOBEC deaminase comprising a R198A mutation of rAPOBEC1, or one or more corresponding mutations in another APOBEC deaminase. In some embodiments an APOBEC deaminase incorporated into a base editor can comprise an APOBEC deaminase comprising a T36A mutation of rAPOBEC1, or one or more corresponding mutations in another APOBEC deaminase. In some embodiments an APOBEC deaminase incorporated into a base editor can comprise an APOBEC deaminase comprising a H53A mutation of rAPOBEC1, or one or more corresponding mutations in another APOBEC deaminase. In some embodiments an APOBEC deaminase incorporated into a base editor can comprise an APOBEC deaminase comprising a V62A mutation of rAPOBEC1, or one or more corresponding mutations in another APOBEC deaminase. In some embodiments an APOBEC deaminase incorporated into a base editor can comprise an APOBEC deaminase comprising a L88A mutation of rAPOBEC1, or one or more corresponding mutations in another APOBEC deaminase. In some embodiments an APOBEC deaminase incorporated into a base editor can comprise an APOBEC deaminase comprising a W90F mutation of rAPOBEC1, or one or more corresponding mutations in another APOBEC deaminase. In some embodiments an APOBEC deaminase incorporated into a base editor can comprise an APOBEC deaminase comprising a Y120F mutation of rAPOBEC1, or one or more corresponding mutations in another APOBEC deaminase. In some embodiments an APOBEC deaminase incorporated into a base editor can comprise an APOBEC deaminase comprising a Y120A mutation of rAPOBEC1, or one or more corresponding mutations in another APOBEC deaminase. In some embodiments an APOBEC deaminase incorporated into a base editor can comprise an APOBEC deaminase comprising a H121R mutation of rAPOBEC1, or one or more corresponding mutations in another APOBEC deaminase. In some embodiments an APOBEC deaminase incorporated into a base editor can comprise an APOBEC deaminase comprising a H122R mutation of rAPOBEC1, or one or more corresponding mutations in another APOBEC deaminase. In some embodiments an APOBEC deaminase incorporated into a base editor can comprise an APOBEC deaminase comprising a R126A mutation of rAPOBEC1, or one or more corresponding mutations in another APOBEC deaminase. In some embodiments, an APOBEC deaminase incorporated into a base editor can comprise an APOBEC deaminase comprising a R126E mutation of rAPOBEC1, or one or more corresponding mutations in another APOBEC deaminase. In some embodiments, an APOBEC deaminase incorporated into a base editor can comprise an APOBEC deaminase comprising a R118A mutation of rAPOBEC1, or one or more corresponding mutations in another APOBEC deaminase. In some embodiments, an APOBEC deaminase incorporated into a base editor can comprise an APOBEC deaminase comprising a W90A mutation of rAPOBEC1, or one or more corresponding mutations in another APOBEC deaminase. In some embodiments, an APOBEC deaminase incorporated into a base editor can comprise an APOBEC deaminase comprising a W90Y mutation of rAPOBEC1, or one or more corresponding mutations in another APOBEC deaminase. In some embodiments, an APOBEC deaminase incorporated into a base editor can comprise an APOBEC deaminase comprising a R132E mutation of rAPOBEC1, or one or more corresponding mutations in another APOBEC deaminase.

In some embodiments, an APOBEC deaminase incorporated into a base editor can comprise a K34A and a R33A mutation of rAPOBEC1, or one or more corresponding mutations in another APOBEC deaminase. In some embodiments, an APOBEC deaminase incorporated into a base editor can comprise a K34A and a H122A mutation of rAPOBEC1, or one or more corresponding mutations in another APOBEC deaminase. In some embodiments, an APOBEC deaminase incorporated into a base editor can comprise a K34A and a Y120F mutation of rAPOBEC1, or one or more corresponding mutations in another APOBEC deaminase. In some embodiments, an APOBEC deaminase incorporated into a base editor can comprise a K34A and a R52A mutation of rAPOBEC1, or one or more corresponding mutations in another APOBEC deaminase. In some embodiments, an APOBEC deaminase incorporated into a base editor can comprise a K34A and a H121A mutation of rAPOBEC1, or one or more corresponding mutations in another APOBEC deaminase. In some embodiments, an APOBEC deaminase incorporated into a base editor can comprise a W90A and a R126E mutation of rAPOBEC1, or one or more corresponding mutations in another APOBEC deaminase. In some embodiments, an APOBEC deaminase incorporated into a base editor can comprise a H121R and a H122R mutation of rAPOBEC1, or one or more corresponding mutations in another APOBEC deaminase. In some embodiments an APOBEC deaminase incorporated into a base editor can comprise an APOBEC deaminase comprising a W90Y and a R126E mutation of rAPOBEC1, or one or more corresponding mutations in another APOBEC deaminase. In some embodiments, an APOBEC deaminase incorporated into a base editor can comprise an APOBEC deaminase comprising a R126E and a R132E mutation of rAPOBEC1, or one or more corresponding mutations in another APOBEC deaminase. In some embodiments, an APOBEC deaminase incorporated into a base editor can comprise an APOBEC deaminase comprising a W90Y and a R132E mutation of rAPOBEC1, or one or more corresponding mutations in another APOBEC deaminase. In some embodiments, an APOBEC deaminase incorporated into a base editor can comprise an APOBEC deaminase comprising a W90Y, R126E, and R132E mutation of rAPOBEC1, or one or more corresponding mutations in another APOBEC deaminase. In some embodiments, an APOBEC deaminase incorporated into a base editor can comprises a Y120F mutation of rAPOBEC1 and one or more corresponding mutations selected from the group consisting of R33A, W90F, K34A, R52A, H122A, and H121A of rAPOBEC1, or one or more corresponding mutations in another APOBEC deaminase.

In some embodiments, an APOBEC deaminase incorporated into a base editor can comprise one or more mutations selected from the group consisting of D316X, D317X, R320X, R320X, R313X, W285X, W285X, R326X of hAPOBEC3G, or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G, or one or more corresponding mutations in another APOBEC deaminase.

In some embodiments, an APOBEC deaminase incorporated into a base editor can comprise an APOBEC deaminase comprising a D316R and a D317R mutation of hAPOBEC3G, or one or more corresponding mutations in another APOBEC deaminase. In some embodiments, any of the fusion proteins provided herein comprise an APOBEC deaminase comprising a R320A mutation of hAPOBEC3G, or one or more corresponding mutations in another APOBEC deaminase. In some embodiments, an APOBEC deaminase incorporated into a base editor can comprise an APOBEC deaminase comprising a R320E mutation of hAPOBEC3G, or one or more corresponding mutations in another APOBEC deaminase. In some embodiments, an APOBEC deaminase incorporated into a base editor can comprise an APOBEC deaminase comprising a R313A mutation of hAPOBEC3G, or one or more corresponding mutations in another APOBEC deaminase. In some embodiments, an APOBEC deaminase incorporated into a base editor can comprise an APOBEC deaminase comprising a W285A mutation of hAPOBEC3G, or one or more corresponding mutations in another APOBEC deaminase. In some embodiments, an APOBEC deaminase incorporated into a base editor can comprise an APOBEC deaminase comprising a W285Y mutation of hAPOBEC3G, or one or more corresponding mutations in another APOBEC deaminase. In some embodiments, an APOBEC deaminase incorporated into a base editor can comprise an APOBEC deaminase comprising a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R320E mutation of hAPOBEC3G, or one or more corresponding mutations in another APOBEC deaminase. In some embodiments, an APOBEC deaminase incorporated into a base editor can comprise an APOBEC deaminase comprising a R320E and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y and a R326E mutation of hAPOBEC3G, or one or more corresponding mutations in another APOBEC deaminase. In some embodiments, an APOBEC deaminase incorporated into a base editor can comprise an APOBEC deaminase comprising a W285Y, R320E, and R326E mutation of hAPOBEC3G, or one or more corresponding mutations in another APOBEC deaminase.

In some embodiments, an APOBEC deaminase incorporated into a base editor can comprise one or more mutations selected from the group consisting of Y130X and R28X of hAPOBEC3A, or one or more corresponding mutations in another APOBEC deaminase, wherein X is any amino acid. In some embodiments, an APOBEC deaminase incorporated into a base editor can comprise a Y130A mutation of hAPOBEC3A, or one or more corresponding mutations in another APOBEC deaminase. In some embodiments, an APOBEC deaminase incorporated into a base editor can comprise a R28A mutation of hAPOBEC3A, or one or more corresponding mutations in another APOBEC deaminase. In some embodiments, an APOBEC deaminase incorporated into a base editor can comprise a Y130A and a R28A mutation of hAPOBEC3A, or one or more corresponding mutations in another APOBEC deaminase.

In some embodiments, an APOBEC deaminase incorporated into a base editor can comprise one or more mutations selected from the group consisting of H122X, K34X, R33X, W90X, and R128X of ppAPOBEC1, or one or more corresponding mutations in another APOBEC deaminase, wherein X is any amino acid. In some embodiments, an APOBEC deaminase incorporated into a base editor can comprise one or more mutations selected from the group consisting of H122A, K34A, R33A, W90F, W90A, and R128A of ppAPOBEC1, or one or more corresponding mutations in another APOBEC deaminase. In some embodiments, an APOBEC deaminase incorporated into a base editor comprises a combination of mutations selected from the group consisting of R33A+K34A, W90F+K34A, R33A+K34A+W90F, and R33A+K34A+H122A+W90F of ppAPOBEC1, or a combination of corresponding mutations in another APOBEC deaminase.

In some embodiments, an APOBEC deaminase incorporated into a base editor can comprise a H122A mutation of ppAPOBEC1, or one or more corresponding mutations in another APOBEC deaminase. In some embodiments, an APOBEC deaminase incorporated into a base editor can comprise a K34A mutation of ppAPOBEC1, or one or more corresponding mutations in another APOBEC deaminase. In some embodiments, an APOBEC deaminase incorporated into a base editor can comprise a R33A mutation of ppAPOBEC1, or one or more corresponding mutations in another APOBEC deaminase. In some embodiments, an APOBEC deaminase incorporated into a base editor can comprise a W90F mutation of ppAPOBEC1, or one or more corresponding mutations in another APOBEC deaminase. In some embodiments, an APOBEC deaminase incorporated into a base editor can comprise a W90A mutation of ppAPOBEC1, or one or more corresponding mutations in another APOBEC deaminase. In some embodiments, an APOBEC deaminase incorporated into a base editor can comprise a R128A mutation of ppAPOBEC1, or one or more corresponding mutations in another APOBEC deaminase. In some embodiments, an APOBEC deaminase incorporated into a base editor can comprise a R33A and a K34A mutation of ppAPOBEC1, or one or more corresponding mutations in another APOBEC deaminase. In some embodiments, an APOBEC deaminase incorporated into a base editor can comprise a W90F and a K34A mutation of ppAPOBEC1, or one or more corresponding mutations in another APOBEC deaminase. In some embodiments, an APOBEC deaminase incorporated into a base editor can comprise a R33A, K34A, and a W90F mutation of ppAPOBEC1, or one or more corresponding mutations in another APOBEC deaminase. In some embodiments, an APOBEC deaminase incorporated into a base editor can comprise a R33A, K34A, H122A and a W90F mutation of ppAPOBEC1, or one or more corresponding mutations in another APOBEC deaminase.

In some embodiments, the APOBEC deaminase incorporated into a base editor is hAPOBEC1, mdAPOECC1, or ppAPOBEC1 with a Y120F mutation, or one or more corresponding mutations in another APOBEC deaminase. In some embodiments, the APOBEC deaminase incorporated into a base editor is hAPOBEC1, mdAPOECC1, or ppAPOBEC1 with a Y120F mutation, and one or more corresponding mutations selected from the group consisting of R33A, W90F, K34A, R52A, H122A, and H121A, or one or more corresponding mutations in another APOBEC deaminase.

A number of modified cytidine deaminases are commercially available, including, but not limited to, SaBE3, SaKKH-BE3, VQR-BE3, EQR-BE3, VRER-BE3, YE1-BE3, EE-BE3, YE2-BE3, and YEE-BE3, which are available from Addgene (plasmids 85169, 85170, 85171, 85172, 85173, 85174, 85175, 85176, 85177). In some embodiments, a deaminase incorporated into a base editor comprises all or a portion of an APOBEC1 deaminase.

Additional Domains

A base editor described herein can include any domain which helps to facilitate the nucleobase editing, modification or altering of a nucleobase of a polynucleotide. In some embodiments, a base editor comprises a polynucleotide programmable nucleotide binding domain (e.g., Cas9), a nucleobase editing domain (e.g., deaminase domain), and one or more additional domains. In some embodiments, the additional domain can facilitate enzymatic or catalytic functions of the base editor, binding functions of the base editor, or be inhibitors of cellular machinery (e.g., enzymes) that could interfere with the desired base editing result. In some embodiments, a base editor can comprise a nuclease, a nickase, a recombinase, a deaminase, a methyltransferase, a methylase, an acetylase, an acetyltransferase, a transcriptional activator, or a transcriptional repressor domain.

In some embodiments, a base editor can comprise an uracil glycosylase inhibitor (UGI) domain. A UGI domain can for example improve the efficiency of base editors comprising a cytidine deaminase domain by inhibiting the conversion of a U formed by deamination of a C back to the C nucleobase. In some embodiments, cellular DNA repair response to the presence of U:G heteroduplex DNA can be responsible for a decrease in nucleobase editing efficiency in cells. In such embodiments, uracil DNA glycosylase (UDG) can catalyze removal of U from DNA in cells, which can initiate base excision repair (BER), mostly resulting in reversion of the U:G pair to a C:G pair. In such embodiments, BER can be inhibited in base editors comprising one or more domains that bind the single strand, block the edited base, inhibit UGI, inhibit BER, protect the edited base, and/or promote repairing of the non-edited strand. Thus, this disclosure contemplates a base editor fusion protein comprising a UGI domain.

In some embodiments, a base editor comprises as a domain all or a portion of a double-strand break (DSB) binding protein. For example, a DSB binding protein can include a Gam protein of bacteriophage Mu that can bind to the ends of DSBs and can protect them from degradation. See Komor, A. C., et al., "Improved base excision repair inhibition and bacteriophage Mu Gam protein yields C:G-to-T:A base editors with higher efficiency and product purity" Science Advances 3:eaao4774 (2017), the entire content of which is hereby incorporated by reference.

Additionally, in some embodiments, a Gam protein can be fused to an N terminus of a base editor. In some embodiments, a Gam protein can be fused to a C-terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See. Komor, A. C., et al., "Improved base excision repair inhibition and bacteriophage Mu Gam protein yields C:G-to-T:A base editors with higher efficiency and product purity" Science Advances 3:eaao4774 (2017). In some embodiments, a mutation or mutations can change the length of a base editor domain relative to a wild-type domain. For example, a deletion of at least one amino acid in at least one domain can reduce the length of the base editor. In another case, a mutation or mutations do not change the length of a domain relative to a wild-type domain. For example, substitution(s) in any domain does/do not change the length of the base editor.

In some embodiments, a base editor can comprise as a domain all or a portion of a nucleic acid polymerase (NAP). For example, a base editor can comprise all or a portion of a eukaryotic NAP. In some embodiments, a NAP or portion thereof incorporated into a base editor is a DNA polymerase. In some embodiments, a NAP or portion thereof incorporated into a base editor has translesion polymerase activity. In some embodiments, a NAP or portion thereof incorporated into a base editor is a translesion DNA polymerase. In some embodiments, a NAP or portion thereof incorporated into a base editor is a Rev7, Rev1 complex, polymerase iota, polymerase kappa, or polymerase eta. In some embodiments, a NAP or portion thereof incorporated into a base editor is a eukaryotic polymerase alpha, beta, gamma, delta, epsilon, gamma, eta, iota, kappa, lambda, mu, or nu component. In some embodiments, a NAP or portion thereof incorporated into a base editor comprises an amino acid sequence that is at least 75%, 80%, 85%, 90%, 95%, 96%, 97%, 98%, 99%, or 99.5% identical to a nucleic acid polymerase (e.g., a translesion DNA polymerase).

Other Nucleobase Editors

The invention provides for a modular multi-effector nucleobase editor wherein virtually any nucleobase editor known in the art can be inserted into the fusion protein described herein or swapped in for a cytidine deaminase or adenosine deaminase. In one embodiment, the invention features a multi-effector nucleobase editor comprising an abasic nucleobase editor domain. Abasic nucleobase editors are known in the art and described, for example, by Kavli et al., EMBO J. 15:3442-3447, 1996, which is incorporated herein by reference.

In one embodiment, a multi-effector nucleobase editor comprises the following domains A-C, A-D, or A-E:

$NH_2$-[A-B-C]-COOH,
$NH_2$-[A-B-C-D]-COOH, or
$NH_2$-[A-B-C-D-E]-COOH wherein A and C or A, C, and E, each comprises one or more of the following: an adenosine deaminase domain or an active fragment thereof, a cytidine deaminase domain or an active fragment thereof, a DNA glycosylase domain or an active fragment thereof; and where B or B and D, each comprises one or more domains having nucleic acid sequence specific binding activity.

In one embodiment, a multi-effector nucleobase editor comprises $NH_2$-[$A_n$-$B_o$-$C_n$]-COOH,
$NH_2$-[$A_n$-$B_o$-$C_n$-$D_o$]-COOH, or
$NH_2$-[$A_n$-$B_o$-$C_p$-$D_o$-Eq]-COOH;

wherein A and C or A, C, and E, each comprises one or more of the following: an adenosine deaminase domain or an active fragment thereof, a cytidine deaminase domain or an active fragment thereof, and a DNA glycosylase domain or an active fragment thereof; and where n is an integer: 1, 2, 3, 4, or 5, and where p is an integer: 0, 1, 2, 3, 4, or 5; and B or B and D each comprises a domain having nucleic acid sequence specific binding activity; and wherein o is an integer: 1, 2, 3, 4, or 5.

Base Editor System

Use of the base editor system provided herein comprises the steps of: (a) contacting a target nucleotide sequence of a polynucleotide (e.g., double- or single stranded DNA or RNA) of a subject with a base editor system comprising an adenosine deaminase domain and/or a cytidine deaminase domain, wherein the aforementioned domains are fused to a polynucleotide binding domain, thereby forming a nucleobase editor capable of inducing changes at one or more bases within a nucleic acid molecule as described herein and at least one guide polynucleic acid (e.g., gRNA), wherein the target nucleotide sequence comprises a targeted nucleobase pair; (b) inducing strand separation of said target region; (c) converting a first nucleobase of said target nucleobase pair in a single strand of the target region to a second nucleobase; and (d) cutting no more than one strand of said target region, where a third nucleobase complementary to the first nucleobase base is replaced by a fourth nucleobase complementary to the second nucleobase. It should be appreciated that in some embodiments, step (b) is omitted. In some embodiments, said targeted nucleobase pair is a plurality of nucleobase pairs in one or more genes. In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more genes, wherein at least one gene is located in a different locus.

In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine.

Base editing system as provided herein provides a new approach to genome editing that uses a fusion protein containing a catalytically defective *Streptococcus pyogenes* Cas9, a cytidine deaminase, and an inhibitor of base excision repair to induce programmable, single nucleotide (C→T or A→G) changes in DNA without generating double-strand DNA breaks, without requiring a donor DNA template, and without inducing an excess of stochastic insertions and deletions.

Provided herein are systems, compositions, and methods for editing a nucleobase using a base editor system. In some embodiments, the base editor system comprises (1) a base editor (BE) comprising a polynucleotide programmable nucleotide binding domain and a nucleobase editing domain (e.g., a deaminase domain) for editing the nucleobase; and (2) a guide polynucleotide (e.g., guide RNA) in conjunction with the polynucleotide programmable nucleotide binding domain. In some embodiments, the base editor system comprises an adenosine base editor (ABE). In some embodiments, the base editor system comprises a cytidine base editor (CBE). In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the nucleobase editing domain is a deaminase domain. In some embodiments, a deaminase domain is a cytosine deaminase or a cytidine deaminase, and/or an adenine deaminase or an adenosine deaminase.

Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, a single guide polynucleotide may be utilized to target a deaminase to a target nucleic acid sequence. In some embodiments, a single pair of guide polynucleotides may be utilized to target different deaminases to a target nucleic acid sequence.

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, the base editor inhibits base excision repair (BER) of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edit of base pair is upstream of a PAM site. In some embodiments, the intended edit of base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edit of base-pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site.

In some embodiments, the method does not require a canonical (e.g., NGG) PAM site. In some embodiments, the nucleobase editor comprises a linker or a spacer. In some embodiments, the linker or spacer is 1-25 amino acids in length. In some embodiments, the linker or spacer is 5-20 amino acids in length. In some embodiments, the linker or spacer is 10, 11, 12, 13, 14, 15, 16, 17, 18, 19, or 20 amino acids in length.

In some embodiments, the base editing fusion proteins provided herein need to be positioned at a precise location, for example, where a target base is placed within a defined region (e.g., a "deamination window"). In some embodiments, a target can be within a 4 base region. In some embodiments, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, the target region comprises a target window, wherein the target window comprises the target nucleobase pair. In some embodiments, the target window comprises 1-10 nucleotides. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edit of base pair is within the target window. In some embodiments, the target window comprises the intended edit of base pair. In some embodiments, the method is performed using any of the base editors provided herein. In some embodiments, a target window is a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a polynucleotide programmable nucleotide binding domain. In some embodiments, an NLS of the base editor is localized C-terminal to a polynucleotide programmable nucleotide binding domain.

Other exemplary features that can be present in a base editor as disclosed herein are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FLASH tags, V5 tags, and SBP-tags. Additional suitable sequences will be apparent to those of skill in the art. In some embodiments, the fusion protein comprises one or more His tags.

Non-limiting examples of protein domains which can be included in the fusion protein include deaminase domains (e.g., cytidine deaminase, adenosine deaminase), a uracil glycosylase inhibitor (UGI) domain, epitope tags, and reporter gene sequences.

Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including, but not limited to, maltose binding protein (MBP), S-tag, Lex A DNA binding domain (DBD) fusions, GAL4 DNA binding domain fusions, and herpes simplex virus (HSV) BP16 protein fusions.

In some embodiments, non-limiting exemplary cytidine base editors (CBE) include BE1 (APOBEC (e.g., APOBEC1)-XTEN-dCas9), BE2 (APOBEC (e.g., APOBEC1)-XTEN-dCas9-UGI), BE3 (APOBEC (e.g., APOBEC1)-XTEN (16 amino acids)-dCas9 (A840H)-UGI), BE3-Gam, saBE3, saBE4-Gam, BE4 (APOBEC (e.g., APOBEC1)-XTEN (32 amino acids)-Cas9n (D10A)-UGI-UGI), BE4-Gam, saBE4, or saB4E-Gam. BE4 extends the APOBEC (e.g., APOBEC1)-Cas9n (D10A) linker to 32 amino acids and the Cas9n-UGI linker to 9 amino acids, and appends a second copy of UGI to the C-terminus of the construct with another 9-amino acid linker into a single base editor construct. In some embodiments, the CBE is saBE3 or saBE4. The base editors saBE3 and saBE4 have the *S. pyogenes* Cas9n (D10A) replaced with the smaller *S. aureus* Cas9n (D10A). BE3-Gam, saBE3-Gam, BE4-Gam, and saBE4-Gam have 174 residues of Gam protein fused to the N-terminus of BE3, saBE3, BE4, and saBE4 via the 16 amino acid XTEN linker. In some embodiments, the CBE is BE3. In some embodiments, the CBE is BE4. In some embodiments, the CBE is BE4max. BE4max is a modified BE4 with a nuclear localization signals (NLS) and optimized codon usage. In some embodiments, BE3 or BE4 comprises an APOBEC selected from the group consisting of APOBEC1, rAPOBEC1, hAPOBEC1, ppAPOBEC1, RrA3F, AmAPOBEC1, mdAPOBEC1, mAPOBEC1, maAPOCBEC1, hA3aA, and SsAPOBEC2.

In some embodiments, the adenosine base editor (ABE) can deaminate adenine in DNA. In some embodiments, ABE is generated by replacing APOBEC component of BE3 with natural or engineered *E. coli* TadA, human ADAR2, mouse ADA, or human ADAT2. In some embodiments, ABE comprises evolved TadA variant. In some embodiments, the ABE is ABE 1.2 (TadA*-XTEN-nCas9-NLS). In some embodiments, TadA* comprises A106V and D108N mutations.

In some embodiments, the ABE is a second-generation ABE. In some embodiments, the ABE is ABE2.1, which comprises additional mutations D147Y and E155V in TadA* (TadA*2.1). In some embodiments, the ABE is ABE2.2, ABE2.1 fused to catalytically inactivated version of human alkyl adenine DNA glycosylase (AAG with E125Q mutation). In some embodiments, the ABE is ABE2.3, ABE2.1 fused to catalytically inactivated version of *E. coli* Endo V (inactivated with D35A mutation). In some embodiments, the ABE is ABE2.6 which has a linker twice as long (32 amino acids, $(SGGS)_2$-XTEN-$(SGGS)_2$ ("$(SGGS)_2$" disclosed as SEQ ID NO: 284)) as the linker in ABE2.1. In some embodiments, the ABE is ABE2.7, which is ABE2.1 tethered with an additional wild-type TadA monomer. In some embodiments, the ABE is ABE2.8, which is ABE2.1 tethered with an additional TadA*2.1 monomer. In some embodiments, the ABE is ABE2.9, which is a direct fusion of evolved TadA (TadA*2.1) to the N-terminus of ABE2.1. In some embodiments, the ABE is ABE2.10, which is a direct fusion of wild-type TadA to the N-terminus of ABE2.1. In some embodiments, the ABE is ABE2.11, which is ABE2.9 with an inactivating E59A mutation at the N-terminus of TadA* monomer. In some embodiments, the ABE is ABE2.12, which is ABE2.9 with an inactivating E59A mutation in the internal TadA* monomer.

In some embodiments, the ABE is a third generation ABE. In some embodiments, the ABE is ABE3.1, which is ABE2.3 with three additional TadA mutations (L84F, H123Y, and I157F).

In some embodiments, the ABE is a fourth generation ABE. In some embodiments, the ABE is ABE4.3, which is ABE3.1 with an additional TadA mutation A142N (TadA*4.3).

In some embodiments, the ABE is a fifth generation ABE. In some embodiments, the ABE is ABE5.1, which is generated by importing a consensus set of mutations from surviving clones (H36L, R51L, S146C, and K157N) into ABE3.1. In some embodiments, the ABE is ABE5.3, which has a heterodimeric construct containing wild-type *E. coli* TadA fused to an internal evolved TadA*. In some embodiments, the ABE is ABE5.2, ABE5.4, ABE5.5, ABE5.6, ABE5.7, ABE5.8, ABE5.9, ABE5.10, ABE5.11, ABE5.12, ABE5.13, or ABE5.14, as shown in below Table 6. In some embodiments, the ABE is a sixth generation ABE. In some embodiments, the ABE is ABE6.1, ABE6.2, ABE6.3, ABE6.4, ABE6.5, or ABE6.6, as shown in below Table 6. In some embodiments, the ABE is a seventh generation ABE. In some embodiments, the ABE is ABE7.1, ABE7.2, ABE7.3, ABE7.4, ABE7.5, ABE7.6, ABE7.7, ABE7.8, ABE 7.9, or ABE7.10, as shown in Table 6 below.

TABLE 6

Genotypes of ABEs

| | 23 | 26 | 36 | 37 | 48 | 49 | 51 | 72 | 84 | 87 | 105 | 108 | 123 | 125 | 142 | 145 | 147 | 152 | 155 | 156 | 157 | 16 |
|---|---|---|---|---|---|---|---|---|---|---|---|---|---|---|---|---|---|---|---|---|---|---|
| ABE0.1 | W | R | H | N | P | | R | N | L | S | A | D | H | G | A | S | D | R | E | I | K | K |
| ABE0.2 | W | R | H | N | P | | R | N | L | S | A | D | H | G | A | S | D | R | E | I | K | K |
| ABE1.1 | W | R | H | N | P | | R | N | L | S | A | N | H | G | A | S | D | R | E | I | K | K |
| ABE1.2 | W | R | H | N | P | | R | N | L | S | V | N | H | G | A | S | D | R | E | I | K | K |
| ABE2.1 | W | R | H | N | P | | R | N | L | S | V | N | H | G | A | S | D | R | V | I | K | K |
| ABE2.2 | W | R | H | N | P | | R | N | L | S | V | N | H | G | A | S | Y | R | V | I | K | K |
| ABE2.3 | W | R | H | N | P | | R | N | L | S | V | N | H | G | A | S | Y | R | V | I | K | K |
| ABE2.4 | W | R | H | N | P | | R | N | L | S | V | N | H | G | A | S | Y | R | V | I | K | K |
| ABE2.5 | W | R | H | N | P | | R | N | L | S | V | N | H | G | A | S | Y | R | V | I | K | K |
| ABE2.6 | W | R | H | N | P | | R | N | L | S | V | N | H | G | A | S | Y | R | V | I | K | K |
| ABE2.7 | W | R | H | N | P | | R | N | L | S | V | N | H | G | A | S | Y | R | V | I | K | K |
| ABE2.8 | W | R | H | N | P | | R | N | L | S | V | N | H | G | A | S | Y | R | V | I | K | K |
| ABE2.9 | W | R | H | N | P | | R | N | L | S | V | N | H | G | A | S | Y | R | V | I | K | K |

TABLE 6-continued

| Genotypes of ABEs | | | | | | | | | | | | | | | | | | | | | | |
|---|---|---|---|---|---|---|---|---|---|---|---|---|---|---|---|---|---|---|---|---|---|---|
| | 23 | 26 | 36 | 37 | 48 | 49 | 51 | 72 | 84 | 87 | 105 | 108 | 123 | 125 | 142 | 145 | 147 | 152 | 155 | 156 | 157 | 16 |
| ABE2.10 | W | R | H | N | P | | R | N | L | S | V | N | H | G | A | S | Y | R | V | I | K | K |
| ABE2.11 | W | R | H | N | P | | R | N | L | S | V | N | H | G | A | S | Y | R | V | I | K | K |
| ABE2.12 | W | R | H | N | P | | R | N | L | S | V | N | H | G | A | S | Y | R | V | I | K | K |
| ABE3.1 | W | R | H | N | P | | R | N | F | S | V | N | Y | G | A | S | Y | R | V | F | K | K |
| ABE3.2 | W | R | H | N | P | | R | N | F | S | V | N | Y | G | A | S | Y | R | V | F | K | K |
| ABE3.3 | W | R | H | N | P | | R | N | F | S | V | N | Y | G | A | S | Y | R | V | F | K | K |
| ABE3.4 | W | R | H | N | P | | R | N | F | S | V | N | Y | G | A | S | Y | R | V | F | K | K |
| ABE3.5 | W | R | H | N | P | | R | N | F | S | V | N | Y | G | A | S | Y | R | V | F | K | K |
| ABE3.6 | W | R | H | N | P | | R | N | F | S | V | N | Y | G | A | S | Y | R | V | F | K | K |
| ABE3.7 | W | R | H | N | P | | R | N | F | S | V | N | Y | G | A | S | Y | R | V | F | K | K |
| ABE3.8 | W | R | H | N | P | | R | N | F | S | V | N | Y | G | A | S | Y | R | V | F | K | K |
| ABE4.1 | W | R | H | N | P | | R | N | L | S | V | N | H | G | N | S | Y | R | V | I | K | K |
| ABE4.2 | W | G | H | N | P | | R | N | L | S | V | N | H | G | N | S | Y | R | V | I | K | K |
| ABE4.3 | W | R | H | N | P | | R | N | F | S | V | N | Y | G | N | S | Y | R | V | F | K | K |
| ABE5.1 | W | R | L | N | P | | L | N | F | S | V | N | Y | G | A | C | Y | R | V | F | N | K |
| ABE5.2 | W | R | H | S | P | | R | N | F | S | V | N | Y | G | A | S | Y | R | V | F | K | T |
| ABE5.3 | W | R | L | N | P | | L | N | I | S | V | N | Y | G | A | C | Y | R | V | I | N | K |
| ABE5.4 | W | R | H | S | P | | R | N | F | S | V | N | Y | G | A | S | Y | R | V | F | K | K |
| ABE5.5 | W | R | L | N | P | | L | N | F | S | V | N | Y | G | A | C | Y | R | V | F | N | K |
| ABE5.6 | W | R | L | N | P | | L | N | F | S | V | N | Y | G | A | C | Y | R | V | F | N | K |
| ABE5.7 | W | R | L | N | P | | L | N | F | S | V | N | Y | G | A | C | Y | R | V | F | N | K |
| ABE5.8 | W | R | L | N | P | | L | N | F | S | V | N | Y | G | A | C | Y | R | V | F | N | K |
| ABE5.9 | W | R | L | N | P | | L | N | F | S | V | N | Y | G | A | C | Y | R | V | F | N | K |
| ABE5.10 | W | R | L | N | P | | L | N | F | S | V | N | Y | G | A | C | Y | R | V | F | N | K |
| ABE5.11 | W | R | L | N | P | | L | N | F | S | V | N | Y | G | A | C | Y | R | V | F | N | K |
| ABE5.12 | W | R | L | N | P | | L | N | F | S | V | N | Y | G | A | C | Y | R | V | F | N | K |
| ABE5.13 | W | R | H | N | P | | L | D | F | S | V | N | Y | A | A | S | Y | R | V | F | K | K |
| ABE5.14 | W | R | H | N | S | | L | N | F | C | V | N | Y | G | A | S | Y | R | V | F | K | K |
| ABE6.1 | W | R | H | N | S | | L | N | F | S | V | N | Y | G | N | S | Y | R | V | F | K | K |
| ABE6.2 | W | R | H | T | P | V | L | N | F | S | V | N | Y | G | N | S | Y | R | V | F | N | K |
| ABE6.3 | W | R | L | S | P | | L | N | F | S | V | N | Y | G | A | C | Y | R | V | F | N | K |
| ABE6.4 | W | R | L | N | S | | L | N | F | S | V | N | Y | G | N | C | Y | R | V | F | N | K |
| ABE6.5 | W | R | L | N | I | V | L | N | F | S | V | N | Y | G | A | C | Y | R | V | F | N | K |
| ABE6.6 | W | R | L | N | T | V | L | N | F | S | V | N | Y | G | N | C | Y | R | V | F | N | K |
| ABE7.1 | W | R | L | N | A | | L | N | F | S | V | N | Y | G | A | C | Y | R | V | F | N | K |
| ABE7.2 | W | R | L | N | A | | L | N | F | S | V | N | Y | G | N | C | Y | R | V | F | N | K |
| ABE7.3 | I | R | L | N | A | | L | N | F | S | V | N | Y | G | A | C | Y | R | V | F | N | K |
| ABE7.4 | R | R | L | N | A | | L | N | F | S | V | N | Y | G | A | C | Y | R | V | F | N | K |
| ABE7.5 | W | R | L | N | A | | L | N | F | S | V | N | Y | G | A | C | Y | H | V | F | N | K |
| ABE7.6 | W | R | L | N | A | | L | N | I | S | V | N | Y | G | A | C | Y | P | V | I | N | K |
| ABE7.7 | L | R | L | N | A | | L | N | F | S | V | N | Y | G | A | C | Y | P | V | F | N | K |
| ABE7.8 | I | R | L | N | A | | L | N | F | S | V | N | Y | G | N | C | Y | R | V | F | N | K |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

In some embodiments, base editors are generated by cloning an adenosine deaminase variantinto a scaffold that includes a circular permutant Cas9 (e.g., CP5 or CP6) and a bipartite nuclear localization sequence. In some embodiments, the base editor (e.g., ABE7.9 orABE7.10) is an NGC PAM CP5 variant (*S. pyrogenes* Cas9 or spVRQR Cas9). In some embodiments, the base editor (e.g., ABE7.9 or ABE7.10) is an AGA PAM CP5 variant (*S. pyrogenes* Cas9 or spVRQR Cas9). In some embodiments, the base editor (e.g., ABE7.9 orABE7.10) is an NGC PAM CP6 variant (*S. pyrogenes* Cas9 or spVRQR Cas9). In some embodiments, the base editor (e.g. ABE7.9 or ABE7.10) is an AGA PAM CP6 variant (*S. pyrogenes* Cas9 or spVRQR Cas9).

In some embodiments, the ABE has a genotype as shown in Table 8 below.

TABLE 8

| Genotypes of ABEs | | | | | | | | | | | | | | | | | | | | | | |
|---|---|---|---|---|---|---|---|---|---|---|---|---|---|---|---|---|---|---|---|---|---|---|
| | 23 | 26 | 36 | 37 | 48 | 49 | 51 | 72 | 84 | 87 | 105 | 108 | 123 | 125 | 142 | 145 | 147 | 152 | 155 | 156 | 157 | 16 |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

In some embodiments, the base editor is a fusion protein comprising a polynucleotide programmable nucleotide binding domain (e.g., Cas9-derived domain) fused to a nucleobase editing domain (e.g., all or a portion of a deaminase domain). In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the base editor further comprises a domain comprising all or a portion of a uracil glycosylase inhibitor (UGI). In some embodiments, the base editor comprises a domain comprising all or a portion of a uracil binding protein (UBP), such as a uracil DNA glycosylase (UDG). In some embodiments, the base editor comprises a domain comprising all or a portion of a nucleic acid polymerase. In some embodiments, a nucleic acid polymerase or portion thereof incorporated into a base editor is a translesion DNA polymerase.

In some embodiments, a domain of the base editor can comprise multiple domains. For example, the base editor comprising a polynucleotide programmable nucleotide binding domain derived from Cas9 can comprise an REC lobe and an NUC lobe corresponding to the REC lobe and NUC lobe of a wild-type or natural Cas9. In another example, the base editor can comprise one or more of a RuvC1 domain, BH domain, REC1 domain, REC2 domain, RuvCII domain, L1 domain, HNH domain, L2 domain, RuvCIII domain, WED domain, TOPO domain or CTD domain. In some embodiments, one or more domains of the base editor comprise a mutation (e.g., substitution, insertion, deletion) relative to a wild-type version of a polypeptide comprising the domain. For example, an HNH domain of a polynucleotide programmable DNA binding domain can comprise an H840A substitution. In another example, a RuvCI domain of a polynucleotide programmable DNA binding domain can comprise a D10A substitution.

Different domains (e.g., adjacent domains) of the base editor disclosed herein can be connected to each other with or without the use of one or more linker domains (e.g., an XTEN linker domain). In some embodiments, a linker domain can be a bond (e.g., covalent bond), chemical group, or a molecule linking two molecules or moieties, e.g., two domains of a fusion protein, such as, for example, a first domain (e.g., Cas9-derived domain) and a second domain (e.g., an adenosine deaminase domain or a cytidine deaminase domain). In some embodiments, a linker is a covalent bond (e.g., a carbon-carbon bond, disulfide bond, carbon-hetero atom bond, etc.). In certain embodiments, a linker is a carbon nitrogen bond of an amide linkage. In certain embodiments, a linker is a cyclic or acyclic, substituted or unsubstituted, branched or unbranched aliphatic or heteroaliphatic linker. In certain embodiments, a linker is polymeric (e.g., polyethylene, polyethylene glycol, polyamide, polyester, etc.). In certain embodiments, a linker comprises a monomer, dimer, or polymer of aminoalkanoic acid. In some embodiments, a linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, a linker comprises a monomer, dimer, or polymer of aminohexanoic acid (Ahx). In certain embodiments, a linker is based on a carbocyclic moiety (e.g., cyclopentane, cyclohexane). In other embodiments, a linker comprises a polyethylene glycol moiety (PEG). In certain embodiments, a linker comprises an aryl or heteroaryl moiety. In certain embodiments, the linker is based on a phenyl ring. A linker can include functionalized moieties to facilitate attachment of a nucleophile (e.g., thiol, amino) from the peptide to the linker. Any electrophile can be used as part of the linker. Exemplary electrophiles include, but are not limited to, activated esters, activated amides, Michael acceptors, alkyl halides, aryl halides, acyl halides, and isothiocyanates. In some embodiments, a linker joins a gRNA binding domain of an RNA-programmable nuclease, including a Cas9 nuclease domain, and the catalytic domain of a nucleic acid editing protein. In some embodiments, a linker joins a dCas9 and a second domain (e.g., UGI, cytidine deaminase, etc.).

Typically, a linker is positioned between, or flanked by, two groups, molecules, or other moieties and connected to each one via a covalent bond, thus connecting the two. In some embodiments, a linker is an amino acid or a plurality of amino acids (e.g., a peptide or protein). In some embodiments, a linker is an organic molecule, group, polymer, or chemical moiety. In some embodiments, a linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length. Longer or shorter linkers are also contemplated. In some embodiments, a linker domain comprises the amino acid sequence SGSETPGTSESATPES (SEQ ID NO: 204), which can also be referred to as the XTEN linker. Any method for linking the fusion protein domains can be employed (e.g., ranging from very flexible linkers of the form (SGGS)n (SEQ ID NO: 205), (GGGS)n (SEQ ID NO: 285), (GGGGS)n (SEQ ID NO: 286), and (G)n, to more rigid linkers of the form (EAAAK)n (SEQ ID NO: 287), (GGS)n, SGSETPGTSESATPES (SEQ ID NO: 204) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference), or $(XP)_n$ motif, in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif (SEQ ID NO: 288), wherein n is 1, 3, or 7. In some embodiments, the Cas9 domain of the fusion proteins provided herein are fused via a linker comprising the amino acid sequence SGSETPGTSESATPES (SEQ ID NO: 204). In some embodiments, a linker comprises a plurality of proline residues and is 5-21, 5-14, 5-9, 5-7 amino acids in length, e.g., PAPAP (SEQ ID NO: 289), PAPAPA (SEQ ID NO: 290), PAPAPAP (SEQ ID NO: 291), PAPAPAPA (SEQ ID NO: 292), $P(AP)_4$ (SEQ ID NO: 293), $P(AP)_7$ (SEQ ID NO: 294), $P(AP)_{10}$ (SEQ ID NO: 295) (see, e.g., Tan J, Zhang F, Karcher D, Bock R. Engineering of high-precision base editors for site-specific single nucleotide replacement. Nat Commun. 2019 Jan. 25; 10(1):439; the entire contents are incorporated herein by reference). Such proline-rich linkers are also termed "rigid" linkers.

A fusion protein of the invention comprises a nucleic acid editing domain. In some embodiments, the deaminase is an adenosine deaminase. In some embodiments, the deaminase is a cytidine deaminase. In some embodiments, the deaminase is an adenosine deaminase and a cytidine deaminase. In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase.

Linkers

In certain embodiments, linkers may be used to link any of the peptides or peptide domains of the invention. The linker may be as simple as a covalent bond, or it may be a polymeric linker many atoms in length. In certain embodiments, the linker is a polypeptide or based on amino acids.

In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length.

In some embodiments, the cytidine deaminase and/or adenosine deaminase and the napDNAbp are fused via a linker that is 4, 16, 32, or 104 amino acids in length. In some embodiments, the linker is about 3 to about 104 amino acids in length. In some embodiments, any of the fusion proteins provided herein, comprise a cytidine deaminase and/or an adenosine deaminase and a Cas9 domain that are fused to each other via a linker. Various linker lengths and flexibilities between the deaminase domain (e.g., cytidine deaminase and/or adenosine deaminase) and the Cas9 domain can be employed (e.g., ranging from very flexible linkers of the form $(GGGS)_n$ (SEQ ID NO: 285), $(GGGGS)_n$ (SEQ ID NO: 286), and $(G)_n$ to more rigid linkers of the form $(EAAAK)_n$ (SEQ ID NO: 287), $(SGGS)_n$ (SEQ ID NO: 205), SGSETPGTSESATPES (SEQ ID NO: 204) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference) and $(XP)_n$) in order to achieve the optimal length for activity for the nucleobase editor or multi-effector nucleobase editor. In some embodiments, n is 1, 2, 3, 4, 5, 6, 7, 8, 9, 10, 11, 12, 13, 14, or 15. In some embodiments, the linker comprises a $(GGS)_n$ motif (SEQ ID NO: 288), wherein n is 1, 3, or 7. In some embodiments, the cytidine deaminase and/or adenosine deaminase and the Cas9 domain of any of the fusion proteins provided herein are fused via a linker (e.g., an XTEN linker) comprising the amino acid sequence SGSETPGTSESATPES (SEQ ID NO: 204).

Cas9 Complexes with Guide RNAs

Some aspects of this disclosure provide complexes comprising any of the fusion proteins provided herein, and a guide RNA (e.g., a guide that targets A\mutation) bound to a CAS9 domain (e.g., a dCas9, a nuclease active Cas9, or a Cas9 nickase) of fusion protein. These complexes are also termed ribonucleoproteins (RNPs). Any method for linking the fusion protein domains can be employed (e.g., ranging from very flexible linkers of the form $(GGGS)_n$ (SEQ ID NO: 285), $(GGGGS)_n$ (SEQ ID NO: 286), and $(G)_n$ to more rigid linkers of the form $(EAAAK)_n$ (SEQ ID NO: 287), $(SGGS)_n$ (SEQ ID NO: 205), SGSETPGTSESATPES (SEQ ID NO: 204) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference) and $(XP)_n$) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif (SEQ ID NO: 288), wherein n is 1, 3, or 7. In some embodiments, the Cas9 domain of the fusion proteins provided herein are fused via a linker comprising the amino acid sequence SGSETPGTSESATPES (SEQ ID NO: 204).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 1 or 5'-NAA-3'). In some embodiments, the guide nucleic acid (e.g., guide RNA) is complementary to a sequence in a gene of interest (e.g., a gene associated with a disease or disorder).

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

In some embodiments, a fusion protein of the invention is used for mutagenizing a target of interest. In particular, a multi-effector nucleobase editor described herein is capable of making multiple mutations within a target sequence. These mutations may affect the function of the target. For example, when a multi-effector nucleobase editor is used to target a regulatory region the function of the regulatory region is altered and the expression of the downstream protein is reduced.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas9 binding, and a guide sequence, which confers sequence specificity to the Cas9: nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Methods of Using Fusion Proteins Comprising a Deaminase and a Cas9 Domain

Some aspects of this disclosure provide methods of using the fusion proteins, or complexes provided herein. For example, some aspects of this disclosure provide methods comprising contacting a DNA molecule encoding a mutant form of a protein with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a Cas9 domain and a deaminase (e.g., adenosine deaminase and/or cytidine deaminase), as disclosed herein, to a target site, e.g., a site comprising a mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9: nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Base Editor Efficiency

CRISPR-Cas9 nucleases have been widely used to mediate targeted genome editing. In most genome editing applications, Cas9 forms a complex with a guide polynucleotide (e.g., single guide RNA (sgRNA)) and induces a double-stranded DNA break (DSB) at the target site specified by the sgRNA sequence. Cells primarily respond to this DSB through the non-homologous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR). Unfortunately, under most non-perturbative conditions, HDR is inefficient, dependent on cell state and cell type, and dominated by a larger frequency of indels. As most of the known genetic variations associated with human disease are point mutations, methods that can more efficiently and cleanly make precise point mutations are needed. Base editing systems as provided herein provide a new way to provide genome editing without generating double-strand DNA breaks, without requiring a donor DNA template, and without inducing an excess of stochastic insertions and deletions.

The fusion proteins of the invention advantageously modify a specific nucleotide base encoding a protein comprising a mutation without generating a significant proportion of indels. An "indel," as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., mutations or deaminations) versus indels.

In some embodiments, any of base editor systems provided herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence.

Some aspects of the disclosure are based on the recognition that any of the base editors provided herein are capable of efficiently generating an intended mutation, such as a point mutation, in a nucleic acid (e.g., a nucleic acid within a genome of a subject) without generating a significant number of unintended mutations, such as unintended point mutations. In some embodiments, any of the base editors provided herein are capable of generating at least 0.01% of intended mutations (i.e. at least 0.01% base editing efficiency). In some embodiments, any of the base editors provided herein are capable of generating at least 0.01%, 1%, 2%, 3%, 4%, 5%, 10%, 15%, 20%, 25%, 30%, 40%, 45%, 50%, 60%, 70%, 80%, 90%, 95%, or 99% of intended mutations.

In some embodiments, the base editors provided herein are capable of generating a ratio of intended mutations to indels that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more.

The number of intended mutations and indels can be determined using any suitable method, for example, as described in International PCT Application Nos. PCT/2017/045381 (WO2018/027078) and PCT/US2016/058344 (WO2017/070632); Komor, A. C., et al., "Programmable editing of a target base in genomic DNA without double-stranded DNA cleavage" Nature 533, 420-424 (2016); Gaudelli, N. M., et al., "Programmable base editing of A·T to G·C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017); the entire contents of which are hereby incorporated by reference.

In some embodiments, to calculate indel frequencies, sequencing reads are scanned for exact matches to two 10-bp sequences that flank both sides of a window in which indels can occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively. In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor.

The number of indels formed at a target nucleotide region can depend on the amount of time a nucleic acid (e.g., a nucleic acid within the genome of a cell) is exposed to a base editor. In some embodiments, the number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing the target nucleotide sequence (e.g., a nucleic acid within the genome of a cell) to a base editor. It should be appreciated that the characteristics of the base editors as described herein can be applied to any of the fusion proteins, or methods of using the fusion proteins provided herein.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, any number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation in a nucleic acid (e.g. a nucleic acid within a genome of a subject) without generating a significant number of unintended mutations. In some embodiments, an intended mutation is a mutation that is generated by a specific base editor bound to a gRNA, specifically designed to alter or correct a HBG mutation.

In some embodiments, any of the base editors provided herein are capable of generating a ratio of intended mutations to unintended mutations (e.g., intended mutations: unintended mutations) that is greater than 1:1. In some embodiments, any of the base editors provided herein are capable of generating a ratio of intended mutations to unintended mutations that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described herein may be applied to any of the fusion proteins, or methods of using the fusion proteins provided herein.

Multiplex Editing

In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more gene, wherein at least one gene is located in a different locus. In some embodiments, the multiplex editing can comprise one or more guide polynucleotides. In some embodiments, the multiplex editing can comprise one or more base editor system. In some embodiments, the multiplex editing can comprise one or more base editor systems with a single guide polynucleotide. In some embodiments, the multiplex editing can comprise one or more base editor system with a plurality of guide polynucleotides. In some embodiments, the multiplex editing can comprise one or more guide polynucleotide with a single base editor system. In some embodiments, the multiplex editing can comprise at least one guide polynucleotide that does not require a PAM sequence to target binding to a target polynucleotide sequence. In some embodiments, the multiplex editing can comprise at least one guide polynucleotide that requires a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editor provided herein. It should also be appreciated that the multiplex editing using any of the base editors as described herein can comprise a sequential editing of a plurality of nucleobase pairs.

In some embodiments, the plurality of nucleobase pairs are in one more genes. In some embodiments, the plurality of nucleobase pairs is in the same gene. In some embodiments, at least one gene in the one more genes is located in a different locus.

In some embodiments, the editing is editing of the plurality of nucleobase pairs in at least one protein coding region. In some embodiments, the editing is editing of the plurality of nucleobase pairs in at least one protein non-coding region. In some embodiments, the editing is editing of the plurality of nucleobase pairs in at least one protein coding region and at least one protein non-coding region.

In some embodiments, the editing is in conjunction with one or more guide polynucleotides. In some embodiments, the base editor system can comprise one or more base editor system. In some embodiments, the base editor system can comprise one or more base editor systems in conjunction with a single guide polynucleotide. In some embodiments, the base editor system can comprise one or more base editor system in conjunction with a plurality of guide polynucleotides. In some embodiments, the editing is in conjunction with one or more guide polynucleotide with a single base editor system. In some embodiments, the editing is in conjunction with at least one guide polynucleotide that does not require a PAM sequence to target binding to a target polynucleotide sequence. In some embodiments, the editing is in conjunction with at least one guide polynucleotide that require a PAM sequence to target binding to a target polynucleotide sequence. In some embodiments, the editing is in conjunction with a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that the editing can comprise a sequential editing of a plurality of nucleobase pairs.

Methods for Editing Nucleic Acids

Some aspects of the disclosure provide methods for editing a nucleic acid. In some embodiments, the method is a method for editing a nucleobase of a nucleic acid molecule encoding a protein (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to a cytidine deaminase and/or adenosine deaminase) and a guide nucleic acid (e.g., gRNA), b) inducing strand separation of said target region, c) converting a first nucleobase of said target nucleobase pair in a single strand of the target region to a second nucleobase, and d) cutting no more than one strand of said target region using the nCas9, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., G·C to A·T). In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a dCas9 domain. In some embodiments, the base editor protects or binds the non-edited strand. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In one embodiment, the linker is 32 amino acids in length. In another embodiment, a "long linker" is at least about 60 amino acids in length. In other embodiments, the linker is between about 3-100 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a methylation window.

In some embodiments, the disclosure provides methods for editing a nucleotide (e.g., SNP in a gene encoding a protein). In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Expression of Fusion Proteins in a Host Cell

Fusion proteins of the invention may be expressed in virtually any host cell of interest, including but not limited to bacteria, yeast, fungi, insects, plants, and animal cells using routine methods known to the skilled artisan. For example, a DNA encoding a fusion protein of the invention can be cloned by designing suitable primers for the upstream and downstream of CDS based on the cDNA sequence. The cloned DNA may be directly, or after digestion with a restriction enzyme when desired, or after addition of a suitable linker and/or a nuclear localization signal ligated with a DNA encoding one or more additional components of a base editing system. The base editing system is translated in a host cell to form a complex.

Fusion proteins are generated by operably linking one or more polynucleotides encoding one or more domains having nucleobase modifying activity (e.g., an adenosine deaminase, cytidine deaminase, DNA glycosylase) to a polynucleotide encoding a napDNAbp to prepare a polynucleotide that encodes a fusion protein of the invention. In some embodiments, a polynucleotide encoding a napDNAbp, and a DNA encoding a domain having nucleobase modifying activity may each be fused with a DNA encoding a binding domain or a binding partner thereof, or both DNAs may be fused with a DNA encoding a separation intein, whereby the nucleic acid sequence-recognizing conversion module and the nucleic acid base converting enzyme are translated in a host cell to form a complex. In these cases, a linker and/or a nuclear localization signal can be linked to a suitable position of one of or both DNAs when desired.

A DNA encoding a protein domain described herein can be obtained by chemically synthesizing the DNA, or by connecting synthesized partly overlapping oligoDNA short chains by utilizing the PCR method and the Gibson Assembly method to construct a DNA encoding the full length thereof. The advantage of constructing a full-length DNA by chemical synthesis or a combination of PCR method or Gibson Assembly method is that the codon to be used can be designed in CDS full-length according to the host into which the DNA is introduced. In the expression of a heterologous DNA, the protein expression level is expected to increase by converting the DNA sequence thereof to a codon highly frequently used in the host organism. As the data of codon use frequency in host to be used, for example, the genetic code use frequency database (kazusa.or.jp/codon/index-.html) disclosed in the home page of Kazusa DNA Research Institute can be used, or documents showing the codon use frequency in each host may be referred to. By reference to the obtained data and the DNA sequence to be introduced, codons showing low use frequency in the host from among those used for the DNA sequence may be converted to a codon coding the same amino acid and showing high use frequency.

An expression vector containing a DNA encoding a nucleic acid sequence-recognizing module and/or a nucleic acid base converting enzyme can be produced, for example, by linking the DNA to the downstream of a promoter in a suitable expression vector.

As the expression vector, *Escherichia coli*-derived plasmids (e.g., pBR322, pBR325, pUC12, pUC13); *Bacillus subtilis*-derived plasmids (e.g., pUB110, pTP5, pC194); yeast-derived plasmids (e.g., pSH19, pSH15); insect cell expression plasmids (e.g., pFast-Bac); animal cell expression plasmids (e.g., pA1-11, pXT1, pRc/CMV, pRc/RSV, pcDNAI/Neo); bacteriophages such as .lamda.phage and the like; insect virus vectors such as baculovirus and the like (e.g., BmNPV, AcNPV); animal virus vectors such as retrovirus, vaccinia virus, adenovirus and the like, and the like are used.

As the promoter, any promoter appropriate for a host to be used for gene expression can be used. In a conventional method using DSB, since the survival rate of the host cell sometimes decreases markedly due to the toxicity, it is desirable to increase the number of cells by the start of the induction by using an inductive promoter. However, since sufficient cell proliferation can also be afforded by expressing the nucleic acid-modifying enzyme complex of the present invention, a constitution promoter can also be used without limitation.

For example, when the host is an animal cell, SR.alpha. promoter, SV40 promoter, LTR promoter, CMV (cytomegalovirus) promoter, RSV (Rous sarcoma virus) promoter, MoMuLV (Moloney mouse leukemia virus) LTR, HSV-TK (simple herpes virus thymidine kinase) promoter and the like are used. Of these, CMV promoter, SR.alpha promoter and the like are preferable. In one embodiment, the promoter is CMV promoter or SR alpha promoter. When the host cell is *Escherichia coli*, any of the following promoters may be used: trp promoter, lac promoter, recA promoter, lamda. P.sub.L promoter, lpp promoter, T7 promoter and the like. When the host is genus *Bacillus*, any of the following promoters may be used: SPO1 promoter, SPO2 promoter, penP promoter and the like. When the host is a yeast, any of the following promoters may be used: Gal1/10 promoter, PHO5 promoter, PGK promoter, GAP promoter, ADH promoter and the like. When the host is an insect cell, any of the following promoters may be used polyhedrin promoter, P10 promoter and the like. When the host is a plant cell, any of the following promoters may be used: CaMV35S promoter, CaMV19S promoter, NOS promoter and the like.

In some embodiments, the expression vector may contain an enhancer, splicing signal, terminator, poly A addition signal, a selection marker such as drug resistance gene, auxotrophic complementary gene and the like, replication origin and the like on demand.

An RNA encoding a protein domain described herein can be prepared by, for example, transcription to mRNA in a vitro transcription system known per se by using a vector encoding DNA encoding the above-mentioned nucleic acid sequence-recognizing module and/or a nucleic acid base converting enzyme as a template.

A fusion protein of the invention can be expressed by introducing an expression vector encoding a fusion protein into a host cell, and culturing the host cell. Host cells useful in the invention include bacterial cells, yeast, insect cells, mammalian cells and the like.

The genus *Escherichia* includes *Escherichia coli* K12.cndot.DH1 (Proc. Natl. Acad. Sci. USA, 60, 160 (1968)], *Escherichia coli* JM103 (Nucleic Acids Research, 9, 309 (1981)], *Escherichia coli* JA221 (Journal of Molecular Biology, 120, 517 (1978)], *Escherichia coli* HB101 (Journal of Molecular Biology, 41, 459 (1969)], *Escherichia coli* C600 (Genetics, 39, 440 (1954)] and the like.

The genus *Bacillus* includes *Bacillus subtilis* M1114 (Gene, 24, 255 (1983)], *Bacillus subtilis* 207-21 (Journal of Biochemistry, 95, 87 (1984)] and the like.

Yeast useful for expressing fusion proteins of the invention include *Saccharomyces cerevisiae* AH22, AH22R.sup.-, NA87-11A, DKD-5D, 20B-12, *Schizosaccharomyces pombe* NCYC1913, NCYC2036, *Pichia pastoris* KM71 and the like.

Fusion proteins are expressed in insect cells using, for example, viral vectors, such as AcNPV. Insect host cells include any of the following cell lines: cabbage armyworm larva-derived established line (*Spodoptera frugiperda* cell; Sf cell), MG1 cells derived from the mid-intestine of *Trichoplusia ni*, High Five™ cells derived from an egg of *Trichoplusia ni, Mamestra brassicae*-derived cells, *Estigmena acrea*-derived cells and the like are used. When the virus is BmNPV, cells of *Bombyx mori*-derived established line (*Bombyx mori* N cell; BmN cell) and the like are used as insect cells. As the Sf cell, for example, Sf9 cell (ATCC CRL1711), Sf21 cell (all above, In Vivo, 13, 213-217 (1977)] and the like.

As the insect, for example, larva of *Bombyx mori, Drosophila*, cricket and the like are used to express fusion proteins (Nature, 315, 592 (1985)).

Mammalian cell lines may be used to express fusion proteins. Such cell lines include monkey COS-7 cell, monkey Vero cell, Chinese hamster ovary (CHO) cell, dhfr gene-deficient CHO cell, mouse L cell, mouse AtT-20 cell, mouse myeloma cell, rat GH3 cell, human FL cell and the like, pluripotent stem cells such as iPS cell, ES cell and the like of human and other mammals, and primary cultured cells prepared from various tissues are used. Furthermore, zebrafish embryo, *Xenopus* oocyte and the like can also be used.

Plant cells may be maintained in culture using methods well known to the skilled artisan. Plant cell culture involves suspending cultured cells, callus, protoplast, leaf segment, root segment and the like prepared from various plants (e.g., grain such as rice, wheat, corn and the like, product crops such as tomato, cucumber, eggplant, carnations, *Eustoma russellianum*, tobacco, *Arabidopsis thaliana*).

All the above-mentioned host cells may be haploid (monoploid), or polyploid (e.g., diploid, triploid, tetraploid and the like). In the conventional mutation introduction methods, mutation is, in principle, introduced into only one homologous chromosome to produce a hetero gene type. Therefore, desired phenotype is not expressed unless dominant mutation occurs, and homozygousness inconveniently requires labor and time. In contrast, according to the present invention, since mutation can be introduced into any allele on the homologous chromosome in the genome, desired phenotype can be expressed in a single generation even in the case of recessive mutation, which is extremely useful since the problem of the conventional method can be solved.

Expression vectors encoding a fusion protein of the invention are introduced into host cells using any transfection method (e.g., lysozyme method, competent method, PEG method, $CaCl_2$) coprecipitation method, electroporation method, the microinjection method, the particle gun method, lipofection method, *Agrobacterium* method and the like). The transfection method is selected based on the host cell to be transfected.

*Escherichia coli* can be transformed according to the methods described in, for example, Proc. Natl. Acad. Sci. USA, 69, 2110 (1972), Gene, 17, 107 (1982) and the like. The genus *Bacillus* can be introduced into a vector according to the methods described in, for example, Molecular & General Genetics, 168, 111 (1979) and the like. Yeast cells can be introduced into a vector according to the methods described in, for example, Methods in Enzymology, 194, 182-187 (1991), Proc. Natl. Acad. Sci. USA, 75, 1929 (1978) and the like. Insect cells can be introduced into a vector according to the methods described in, for example, Bio/Technology, 6, 47-55 (1988) and the like. Mammalian cells can be introduced into a vector according to the methods described in, for example, Cell Engineering additional volume 8, New Cell Engineering Experiment Protocol, 263-267 (1995) (published by Shujunsha), and Virology, 52, 456 (1973).

Cells comprising expression vectors of the invention are cultured according to known methods, which vary depending on the host. For example, when *Escherichia coli* or genus *Bacillus* are cultured, a liquid medium is preferable as a medium to be used for the culture. The medium preferably contains a carbon source, nitrogen source, inorganic substance and the like necessary for the growth of the transformant. Examples of the carbon source include glucose, dextrin, soluble starch, sucrose and the like; examples of the nitrogen source include inorganic or organic substances such as ammonium salts, nitrate salts, corn steep liquor, peptone, casein, meat extract, soybean cake, potato extract and the like; and examples of the inorganic substance include calcium chloride, sodium dihydrogen phosphate, magnesium chloride and the like. The medium may contain yeast extract, vitamins, growth promoting factor and the like. The pH of the medium is preferably about 5-about 8.

As a medium for culturing *Escherichia coli*, for example, M9 medium containing glucose, casamino acid (Journal of Experiments in Molecular Genetics, 431-433, Cold Spring Harbor Laboratory, New York 1972] is preferable. Where necessary, for example, agents such as 3.beta.-indolylacrylic acid may be added to the medium to ensure an efficient function of a promoter. *Escherichia coli* is cultured at generally about 15-about 43° C. Where necessary, aeration and stirring may be performed.

The genus *Bacillus* is cultured at generally about 30-about 40° C. Where necessary, aeration and stirring may be performed.

Examples of the medium for culturing yeast include Burkholder minimum medium (Proc. Natl. Acad. Sci. USA, 77, 4505 (1980)], SD medium containing 0.5% casamino acid (Proc. Natl. Acad. Sci. USA, 81, 5330 (1984)] and the like. The pH of the medium is preferably about 5-about 8. The culture is performed at generally about 20° C. . . . about 35° C. Where necessary, aeration and stirring may be performed.

As a medium for culturing an insect cell or insect, for example, Grace's Insect Medium (Nature, 195, 788 (1962)] containing an additive such as inactivated 10% bovine serum and the like as appropriate and the like are used. The pH of the medium is preferably about 6.2 to about 6.4. The culture is performed at generally about 27° C. Where necessary, aeration and stirring may be performed.

As a medium for culturing an animal cell, for example, minimum essential medium (MEM) containing about 5-about 20% of fetal bovine serum (Science, 122, 501 (1952)], Dulbecco's modified Eagle medium (DMEM) (Virology, 8, 396 (1959)], RPMI 1640 medium (The Journal of the American Medical Association, 199, 519 (1967)], 199 medium (Proceeding of the Society for the Biological Medicine, 73, 1 (1950)] and the like are used. The pH of the medium is preferably about 6-about 8. The culture is performed at generally about 30° C. to about 40° C. Where necessary, aeration and stirring may be performed.

As a medium for culturing a plant cell, for example, MS medium, LS medium, B5 medium and the like are used. The pH of the medium is preferably about 5-about 8. The culture is performed at generally about 20° C.-about 30° C. Where necessary, aeration and stirring may be performed.

When a higher eukaryotic cell, such as animal cell, insect cell, plant cell and the like is used as a host cell, a DNA encoding a base editing system of the present invention is introduced into a host cell under the regulation of an inducible promoter (e.g., metallothionein promoter (induced by heavy metal ion), heat shock protein promoter (induced by heat shock), Tet-ON/Tet-OFF system promoter (induced by addition or removal of tetracycline or a derivative thereof), steroid-responsive promoter (induced by steroid hormone or a derivative thereof) etc.), the induction substance is added to the medium (or removed from the medium) at an appropriate stage to induce expression of the nucleic acid-modifying enzyme complex, culture is performed for a given period to carry out a base editing and, introduction of a mutation into a target gene, transient expression of the base editing system can be realized.

Prokaryotic cells such as *Escherichia coli* and the like can utilize an inducible promoter. Examples of the inducible promoter include, but are not limited to, lac promoter (induced by IPTG), cspA promoter (induced by cold shock), araBAD promoter (induced by arabinose) and the like.

Alternatively, the above-mentioned inductive promoter can also be utilized as a vector removal mechanism when higher eukaryotic cells, such as animal cell, insect cell, plant cell and the like are used as a host cell. That is, a vector is mounted with a replication origin that functions in a host cell, and a nucleic acid encoding a protein necessary for replication (e.g., SV40 on and large T antigen, oriP and EBNA-1 etc. for animal cells), of the expression of the nucleic acid encoding the protein is regulated by the above-mentioned inducible promoter. As a result, while the vector is autonomously replicatable in the presence of an induction substance, when the induction substance is removed, autonomous replication is not available, and the vector naturally falls off along with cell division (autonomous replication is not possible by the addition of tetracycline and doxycycline in Tet-OFF system vector).

Delivery System

Nucleic Acid-Based Delivery of a Nucleobase Editors and gRNAs

Nucleic acids encoding base editing systems (e.g., multi-effector nucleobase editor) according to the present disclosure can be administered to subjects or delivered into cells in vitro or in vivo by art-known methods or as described herein. In one embodiment, nucleobase editors or multi-effector nucleobase editors can be delivered by, e.g., vectors (e.g., viral or non-viral vectors), non-vector based methods (e.g., using naked DNA, DNA complexes, lipid nanoparticles), or a combination thereof.

Nucleic acids encoding nucleobase editors or multi-effector nucleobase editors can be delivered directly to cells (e.g., hematopoietic cells or their progenitors, hematopoietic stem cells, and/or induced pluripotent stem cells) as naked DNA or RNA, for instance by means of transfection or electroporation, or can be conjugated to molecules (e.g., N-acetylgalactosamine) promoting uptake by the target cells. Nucleic acid vectors, such as the vectors described herein can also be used.

Nucleic acid vectors can comprise one or more sequences encoding a domain of a fusion protein described herein. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40), and deaminase (e.g., an adenosine deaminase and/or cytidine deaminase).

The nucleic acid vector can also include any suitable number of regulatory/control elements, e.g., promoters, enhancers, introns, polyadenylation signals, Kozak consensus sequences, or internal ribosome entry sites (IRES). These elements are well known in the art. For hematopoietic cells suitable promoters can include IFNbeta or CD45.

Nucleic acid vectors according to this disclosure include recombinant viral vectors. Exemplary viral vectors are set forth herein. Other viral vectors known in the art can also be used. In addition, viral particles can be used to deliver base editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems according to the present disclosure. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 10 (below).

TABLE 10

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |

TABLE 10-continued

Lipids Used for Gene Transfer

| Lipid | Abbreviation | Feature |
|---|---|---|
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethyl-ammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 11 lists exemplary polymers for use in gene transfer and/or nanoparticle formulations.

TABLE 11

Polymers Used for Gene Transfer

| Polymer | Abbreviation |
|---|---|
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |

TABLE 11-continued

Polymers Used for Gene Transfer

| Polymer | Abbreviation |
|---|---|
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 12 summarizes delivery methods for a polynucleotide encoding a fusion protein described herein.

TABLE 12

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

In another aspect, the delivery of genome editing system components or nucleic acids encoding such components, for example, a nucleic acid binding protein such as, for example, Cas9 or variants thereof, and a gRNA targeting a genomic nucleic acid sequence of interest, may be accomplished by delivering a ribonucleoprotein (RNP) to cells. The RNP comprises the nucleic acid binding protein, e.g., Cas9, in complex with the targeting gRNA. RNPs may be delivered to cells using known methods, such as electroporation, nucleofection, or cationic lipid-mediated methods, for example, as reported by Zuris, J. A. et al., 2015, *Nat. Biotechnology,* 33(1):73-80. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid based techniques, RNPs can be used to deliver binding protein (e.g., Cas9 variants) and to direct homology directed repair (HDR).

A promoter used to drive base editor coding nucleic acid molecule expression can include AAV ITR. This can be advantageous for eliminating the need for an additional promoter element, which can take up space in the vector. The additional space freed up can be used to drive the expression of additional elements, such as a guide nucleic acid or a selectable marker. ITR activity is relatively weak, so it can be used to reduce potential toxicity due to over expression of the chosen nuclease.

Any suitable promoter can be used to drive expression of the base editor and, where appropriate, the guide nucleic acid. For ubiquitous expression, promoters that can be used include CMV, CAG, CBh, PGK, SV40, Ferritin heavy or light chains, etc. For brain or other CNS cell expression, suitable promoters can include: SynapsinI for all neurons, CaMKIIalpha for excitatory neurons, GAD67 or GAD65 or VGAT for GABAergic neurons, etc. For liver cell expression, suitable promoters include the Albumin promoter. For lung cell expression, suitable promoters can include SP-B. For endothelial cells, suitable promoters can include ICAM. For hematopoietic cells suitable promoters can include IFN-beta or CD45. For Osteoblasts suitable promoters can include OG-2.

In some embodiments, a base editor of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters such as U6 or H1 Use of Pol II promoter and intronic cassettes to express gRNA Adeno Associated Virus (AAV).

Viral Vectors

A base editor described herein can therefore be delivered with viral vectors. In some embodiments, a base editor disclosed herein can be encoded on a nucleic acid that is contained in a viral vector. In some embodiments, one or more components of the base editor system can be encoded on one or more viral vectors. For example, a base editor and guide nucleic acid can be encoded on a single viral vector. In other embodiments, the base editor and guide nucleic acid are encoded on different viral vectors. In either case, the base editor and guide nucleic acid can each be operably linked to a promoter and terminator. The combination of components encoded on a viral vector can be determined by the cargo size constraints of the chosen viral vector.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

Viral vectors can include lentivirus (e.g., HIV and FIV-based vectors), Adenovirus (e.g., AD100), Retrovirus (e.g., Maloney murine leukemia virus, MML-V), herpesvirus vectors (e.g., HSV-2), and Adeno-associated viruses (AAVs), or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (See, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some embodiments, a base editor of the present disclosure is of sufficient size so as to enable efficient packaging and delivery into a target cell via a retroviral vector. In some embodiments, a base editor is of a size so as to allow efficient packing and delivery even when expressed together with a guide nucleic acid and/or other components of a targetable nuclease system.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors can also be used to transduce cells with target nucleic acids, e.g., in the in vitro production of nucleic acids and peptides, and for in vivo and ex vivo gene therapy procedures (See, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1.

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

Viral vectors can be selected based on the application. For example, for in vivo gene delivery, AAV can be advantageous over other viral vectors. In some embodiments, AAV allows low toxicity, which can be due to the purification method not requiring ultra-centrifugation of cell particles that can activate the immune response. In some embodiments, AAV allows low probability of causing insertional mutagenesis because it doesn't integrate into the host genome. Adenoviruses are commonly used as vaccines because of the strong immunogenic response they induce. Packaging capacity of the viral vectors can limit the size of the base editor that can be packaged into the vector.

AAV has a packaging capacity of about 4.5 Kb or 4.75 Kb including two 145 base inverted terminal repeats (ITRs). This means disclosed base editor as well as a promoter and transcription terminator can fit into a single viral vector. Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some embodiments, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. A tabulation of certain AAV serotypes as to these cells can be found in Grimm, D. et al, J. Virol. 82:5887-5911 (2008)).

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media is changed to OptiMEM (serum-free) media and transfection was done 4 hours later. Cells are transfected with 10 μg of lentiviral transfer plasmid (pCasES10) and the following packaging plasmids: 5 μg of pMD2.G (VSV-g pseudotype), and 7.5 μg of psPAX2 (gag/pol/rev/tat). Transfection can be done in 4 mL OptiMEM with a cationic lipid delivery agent (50 μl Lipofectamine 2000 and 100 μl Plus reagent). After 6 hours, the media is changed to antibiotic-free DMEM with 10% fetal bovine serum. These methods use serum during cell culture, but serum-free methods are preferred.

Lentivirus can be purified as follows. Viral supernatants are harvested after 48 hours. Supernatants are first cleared of debris and filtered through a 0.45 μm low protein binding (PVDF) filter. They are then spun in an ultracentrifuge for 2 hours at 24,000 rpm. Viral pellets are resuspended in 50 μl of DMEM overnight at 4° C. They are then aliquoted and immediately frozen at −80° C.

In another embodiment, minimal non-primate lentiviral vectors based on the equine infectious anemia virus (EIAV) are also contemplated. In another embodiment, RetinoStat®, an equine infectious anemia virus-based lentiviral gene therapy vector that expresses angiostatic proteins endostatin and angiostatin that is contemplated to be delivered via a subretinal injection. In another embodiment, use of self-inactivating lentiviral vectors are contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional kozak sequence (GCCACC), nuclease sequence, and 3' UTR such as a 3' UTR from beta globin-polyA tail. The cassette can be used for transcription by T7 polymerase. Guide polynucleotides (e.g., gRNA) can also be transcribed using in vitro transcription from a cassette containing a T7 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. In one embodiment, inteins are utilized to join fragments or portions of a multi-effector base editor protein that is grafted onto an AAV capsid protein. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In one embodiment, dual AAV vectors are generated by splitting a large transgene expression cassette in two separate halves (5' and 3' ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5' and 3' genomes (dual AAV overlapping vectors); (2) ITR-mediated tail-to-head concatemerization of 5' and 3' genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

Inteins

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

Inteins (intervening protein) are auto-processing domains found in a variety of diverse organisms, which carry out a process known as protein splicing. Protein splicing is a multi-step biochemical reaction comprised of both the cleavage and formation of peptide bonds. While the endogenous substrates of protein splicing are proteins found in intein-containing organisms, inteins can also be used to chemically manipulate virtually any polypeptide backbone.

In protein splicing, the intein excises itself out of a precursor polypeptide by cleaving two peptide bonds, thereby ligating the flanking extein (external protein) sequences via the formation of a new peptide bond. This rearrangement occurs post-translationally (or possibly co-translationally). Intein-mediated protein splicing occurs spontaneously, requiring only the folding of the intein domain.

About 5% of inteins are split inteins, which are transcribed and translated as two separate polypeptides, the N-intein and C-intein, each fused to one extein. Upon translation, the intein fragments spontaneously and non-covalently assemble into the canonical intein structure to carry out protein splicing in trans. The mechanism of protein splicing entails a series of acyl-transfer reactions that result in the cleavage of two peptide bonds at the intein-extein junctions and the formation of a new peptide bond between the N- and C-exteins. This process is initiated by activation of the peptide bond joining the N-extein and the N-terminus of the intein. Virtually all inteins have a cysteine or serine at their N-terminus that attacks the carbonyl carbon of the C-terminal N-extein residue. This N to O/S acyl-shift is facilitated by a conserved threonine and histidine (referred to as the TXXH motif), along with a commonly found aspartate, which results in the formation of a linear (thio) ester intermediate. Next, this intermediate is subject to trans-(thio) esterification by nucleophilic attack of the first C-extein residue (+1), which is a cysteine, serine, or threonine. The resulting branched (thio) ester intermediate is resolved through a unique transformation: cyclization of the highly conserved C-terminal asparagine of the intein. This process is facilitated by the histidine (found in a highly conserved HNF motif) and the penultimate histidine and may also involve the aspartate. This succinimide formation reaction excises the intein from the reactive complex and leaves behind the exteins attached through a non-peptidic linkage. This structure rapidly rearranges into a stable peptide bond in an intein-independent fashion.

In some embodiments, an N-terminal fragment of a base editor (e.g., ABE, CBE) is fused to a split intein-N and a C-terminal fragment is fused to a split intein-C. These fragments are then packaged into two or more AAV vectors. The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

In some embodiments, an ABE was split into N- and C-terminal fragments at Ala, Ser, Thr, or Cys residues within selected regions of SpCas9. These regions correspond to loop regions identified by Cas9 crystal structure analysis. The N-terminus of each fragment is fused to an intein-N and the C-terminus of each fragment is fused to an intein C at amino acid positions S303, T310, T313, S355, A456, S460, A463, T466, S469, T472, T474, C574, S577, A589, and S590, which are indicated in Bold Capitals in the sequence below.

(SEQ ID NO: 225)

```
  1 mdkkysigld igtnsvgwav itdeykvpsk kfkvlgntdr hsikknliga llfdsgetae

 61 atrlkrtarr rytrrknric ylqeifsnem akvddsffhr leesflveed kkherhpifg

121 nivdevayhe kyptiyhlrk klvdstdkad lrliylalah mikfrghfli egdlnpdnsd

181 vdklfiqlvq tynqlfeenp inasgvdaka ilsarlsksr rlenliaqlp gekkngllfgn

241 lialslgltp nfksnfdlae daklqlskdt ydddldnlla qigdqyadlf laaknlsdai
```

-continued

```
301  llSdilrvnT eiTkaplsas mikrydehhq dltllkalvr qqlpekykei ffdqSkngya
361  gyidggasqe efykfikpil ekmdgteell vklnredllr kqrtfdngsi phqihlgelh
421  ailrrqedfy pflkdnreki ekiltfripy yvgplArgnS rfAwmTrkSe eTiTpwnfee
481  vvdkgasaqs fiermtnfdk nlpnekvlpk hsllyeyftv yneltkvkyv tegmrkpafl
541  sgeqkkaivd llfktnrkvt vkqlkedyfk kieCfdSvei sgvedrfnAS lgtyhdllki
601  ikdkdfldne enediledIv ltltlfedre mieerlktya hlfddkvmkq lkrrrytgwg
661  rlsrklingi rdkqsgktil dflksdgfan rnfmqlihdd sltfkediqk aqvsgqgdsl
721  hehianlags paikkgilqt vkvvdelvkv mgrhkpeniv iemarenqtt qkgqknsrer
781  mkrieegike lgsqilkehp ventqlqnek lylyylangr dmyvdgeldi nrlsdydvdh
841  ivpqsflkdd sidnkvltrs dknrgksdnv pseevvkkmk nywrqllnak litqrkfdnl
901  tkaergglse ldkagfikrq lvetrqitkh vaqildsrmn tkydendkli revkvitlks
961  klvsdfrkdf qfykvreinn yhhahdayln avvgtalikk ypklesefvy gdykvydvrk
1021 miakseqeig katakyffys nimnffktei tlangeirkr plietngetg eivwdkgrdf
1081 atvrkvlsmp qvnivkktev qtggfskesi lpkrnsdkli arkkdwdpkk yggfdsptva
1141 ysvlvvakve kgkskklksv kellgitime rssfeknpid fleakgykev kkdliiklpk
1201 yslfelengr krmlasagel qkgnelalps kyvnflylas hyeklkgspe dneqkqlfve
1261 qhkhyldeii eqisefskrv iladanldkv lsaynkhrdk pireqaenii hlftltnlga
1321 paafkyfdtt idrkrytstk evldatlihq sitglyetri dlsqlggd
```

Use of Nucleobase Editors to Target Mutations

The suitability of nucleobase editors or multi-effector nucleobase editors that target one or more mutations is evaluated as described herein. In one embodiment, a single cell of interest is transduced with a base editing system together with a small amount of a vector encoding a reporter (e.g., GFP). These cells can be any cell line known in the art, including immortalized human cell lines, such as 293T, K562 or U20S. Alternatively, primary cells (e.g., human) may be used. Such cells may be relevant to the eventual cell target.

Delivery may be performed using a viral vector. In one embodiment, transfection may be performed using lipid transfection (such as Lipofectamine or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq).

The fusion proteins that induce the greatest levels of target specific alterations in initial tests can be selected for further evaluation.

In particular embodiments, the nucleobase editors or multi-effector base editors are used to target polynucleotides of interest. In one embodiment, a nucleobase editor or multi-effector base editor of the invention is delivered to cells (e.g., hematopoietic cells or their progenitors, hematopoietic stem cells, and/or induced pluripotent stem cells) in conjunction with a guide RNA that is used to target a mutation of interest within the genome of a cell, thereby altering the mutation. In some embodiments, a base editor is targeted by a guide RNA to introduce one or more edits to the sequence of a gene of interest.

In one embodiment, a nucleobase editor or multi-effector nucleobase editor is used to target a regulatory sequence, including but not limited to splice sites, enhancers, and transcriptional regulatory elements. The effect of the alteration on the expression of a gene controlled by the regulatory element is then assayed using any method known in the art.

In other embodiments, a nucleobase editor or multi-effector nucleobase editor of the invention is used to target a polynucleotide encoding a Complementarity Determining Region (CDR), thereby creating alterations in the expressed CDR. The effect of these alterations on CDR function is then assayed, for example, by measuring the specific binding of the CDR to its antigen.

In still other embodiments, a multi-effector nucleobase editor of the invention is used to target polynucleotides of interest within the genome of an organism. In one embodiment, a multi-effector nucleobase editor of the invention is delivered to cells in conjunction with a library of guide RNAs that are used to tile a variety of sequences within the genome of a cell, thereby systematically altering sequences throughout the genome.

The system can comprise one or more different vectors. In an aspect, the base editor is codon optimized for expression the desired cell type, preferentially a eukaryotic cell, preferably a mammalian cell or a human cell.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/(visited Jul. 9, 2002), and these tables can be adapted in a number of ways. See, Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper. The helper virus can promote replication of the AAV vector and expression of AAV genes from the helper plasmid. The helper plasmid in some cases is not packaged in significant amounts due to a lack of ITR sequences. Contamination with adenovirus can be reduced by, e.g., heat treatment to which adenovirus is more sensitive than AAV.

Applications for Multi-Effector Nucleobase Editors

The multi-effector nucleobase editors can be used to target polynucleotides of interest to create alterations that modify protein expression. In one embodiment, a multi-effector nucleobase editor is used to modify a non-coding or regulatory sequence, including but not limited to splice sites, enhancers, and transcriptional regulatory elements. The effect of the alteration on the expression of a gene controlled by the regulatory element is then assayed using any method known in the art. In a particular embodiment, a multi-effector nucleobase editor is able to substantially alter a regulatory sequence, thereby abolishing its ability to regulate gene expression. Advantageously, this can be done without generating double-stranded breaks in the genomic target sequence, in contrast to other RNA-programmable nucleases.

The multi-effector nucleobase editors can be used to target polynucleotides of interest to create alterations that modify protein activity. In the context of mutagenesis, for example, multi-effector nucleobase editors have a number of advantages over error-prone PCR and other polymerase-based methods. Because multi-effector nucleobase editors of the invention create alterations at multiple bases in a target region, such mutations are more likely to be expressed at the protein level relative to mutations introduced by error-prone PCR, which are less likely to be expressed at the protein level given that a single nucleotide change in a codon may still encode the same amino acid (e.g., codon degeneracy). Unlike error-prone PCR, which induces random alterations throughout a polynucleotide, multi-effector nucleobase editors of the invention can be used to target specific amino acids within a small or defined region of a protein of interest.

In other embodiments, a multi-effector nucleobase editor of the invention is used to target a polynucleotide of interest within the genome of an organism. In one embodiment, the organism is a bacteria of the microbiome (e.g., Bacteriodetes, Verrucomicrobia, Firmicutes; Gammaproteobacteria, Alphaproteobacteria, Bacteriodetes, Clostridia, Erysipelotrichia, Bacilli; Enterobacteriales, Bacteriodales, Verrucomicrobiales, Clostridiales, Erysiopelotrichales, *Lactobacillus*; Enterobacteriaceae, Bacteroidaceae, Erysiopelotrichaceae, Prevotellaceae, Coriobacteriaceae, and Alcaligenaceae, *Escherichia, Bacteroides*, Alistipes, Akkermansia, *Clostridium, Lactobacillus*). In another embodiment, the organism is an agriculturally important animal (e.g., cow, sheep, goat, horse, chicken, turkey) or plant (e.g., soybeans, wheat, corn, rice, tobacco, apples, grapes, peaches, plums, cherries). In one embodiment, a multi-effector nucleobase editor of the invention is delivered to cells in conjunction with a library of guide RNAs that are used to tile a variety of sequences within the genome of a cell, thereby systematically altering sequences throughout the genome.

Mutations may be made in any of a variety of proteins to facilitate structure function analysis or to alter the endogenous activity of the protein. Mutations may be made, for example, in an enzyme (e.g., kinase, phosphatase, carboxylase, phosphodiesterase) or in an enzyme substrate, in a receptor or in its ligand, and in an antibody and its antigen. In one embodiment, a multi-effector nucleobase editor targets a nucleic acid molecule encoding the active site of the enzyme, the ligand binding site of a receptor, or a complementarity determining region (CDR) of an antibody. In the case of an enzyme, inducing mutations in the active site could increase, decrease, or abolish the enzyme's activity. The effect of mutations on the enzyme is characterized in an enzyme activity assay, including any of a number of assays known in the art and/or that would be apparent to the skilled artisan. In the case of a receptor, mutations made at the ligand binding site could increase, decrease or abolish the receptors affinity for its ligand. The effect of such mutations is assayed in a receptor/ligand binding assay, including any of a number of assays known in the art and/or that would be apparent to the skilled artisan. In the case of a CDR, mutations made within the CDR could increase, decrease or abolish binding to the antigen. Alternatively, mutations made within the CDR could alter the specificity of the antibody for the antigen. The effect of these alterations on CDR function is then assayed, for example, by measuring the specific binding of the CDR to its antigen or in any other type of immunoassay.

Pharmaceutical Compositions

Other aspects of the present disclosure relate to pharmaceutical compositions comprising any of the base editors, fusion proteins, or the fusion protein-guide polynucleotide complexes described herein. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

Suitable pharmaceutically acceptable carriers generally comprise inert substances that aid in administering the pharmaceutical composition to a subject, aid in processing the pharmaceutical compositions into deliverable preparations, or aid in storing the pharmaceutical composition prior to administration. Pharmaceutically acceptable carriers can include agents that can stabilize, optimize or otherwise alter the form, consistency, viscosity, pH, pharmacokinetics, solubility of the formulation.

Some nonlimiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Buffering agents, wetting agents, emulsifying agents, diluents, encapsulating agents, skin penetration enhancers, coloring agents, release agents, coating agents, sweetening agents, flavoring agents, perfuming agents, preservative and antioxidants can also be present in the formulation. For example, carriers can include, but are not limited to, saline, buffered saline, dextrose, arginine, sucrose, water, glycerol, ethanol, sorbitol, dextran, sodium carboxymethyl cellulose, and combinations thereof.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g., tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject, e.g., for gene editing. In some embodiments, administration of the pharmaceutical compositions contemplated herein may be carried out using conventional techniques including, but not limited to, infusion, transfusion, or parenterally. In some embodiments, parenteral administration includes infusing or injecting intravascularly, intravenously, intramuscularly, intraarterially, intrathecally, intratumorally, intradermally, intraperitoneally, transtracheally, subcutaneously, subcuticularly, intraarticularly, subcapsularly, subarachnoidly and intrasternally. In some embodiments, suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249:1527-1533; Sefton, 1989, CRC Crit. Ref. Biomed. Eng. 14:201; Buchwald et al., 1980, Surgery 88:507; Saudek et al, 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et ah, 1989, J. Neurosurg. 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et ah, Gene Ther. 1999, 6:1438-47). Positively charged lipids such as N-[1-(2,3-dioleoyloxi) propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication number WO2011/053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

In some embodiments, compositions in accordance with the present disclosure can be used for treatment of any of a variety of diseases, disorders, and/or conditions.

Kits, Vectors, Cells

Various aspects of this disclosure provide kits comprising a base editor system. In one embodiment, the kit comprises a nucleic acid construct comprising a nucleotide sequence encoding a nucleobase editor fusion protein. The fusion protein comprises one or more deaminase domains (e.g., cytidine deaminase and/or adenine deaminase) and a nucleic acid programmable DNA binding protein (napDNAbp). In some embodiments, the kit comprises at least one guide RNA capable of targeting a nucleic acid molecule of interest. In some embodiments, the kit comprises a nucleic acid construct comprising a nucleotide sequence encoding at least one guide RNA. In some embodiments, the kit comprises a nucleic acid construct, comprising a nucleotide sequence encoding (a) a Cas9 domain fused to an adenosine deaminase and/or a cytidine deaminase as provided herein; and (b) a heterologous promoter that drives expression of the sequence of (a).

The kit provides, in some embodiments, instructions for using the kit to edit one or more mutations. The instructions will generally include information about the use of the kit for editing nucleic acid molecules. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

Some aspects of this disclosure provide cells comprising any of the nucleobase editors or multi-effector nucleobase editors or fusion proteins provided herein. In some embodiments, the cells comprise any of the nucleotides or vectors provided herein.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: Alternative Cytidine Base Editors with Reduced DNA and RNA Off-Target Editing Base editors are promising tools to reverse pathogenic point mutations in human genome without creating harmful double strand breaks. However, cytidine or adenine base editors (CBEs or ABEs) were reported to introduce tens of thousands of transcriptome-wide RNA spurious mutations. CBEs, not ABEs, were also reported to cause substantial genome-wide DNA spurious mutations in mouse embryos and plants. To reduce off-target editing caused by CBEs by utilizing alternative cytidine deaminases and structure-guided mutagenesis, several novel CBEs were identified including ones from non-human primates from a screen of 153 cytidine deaminases, which displayed an improved editing profile compared to previous CBEs. These new CBEs and their mutants displayed minimal DNA and RNA spurious deamination. These new CBEs (BE4-ppAPOBEC1

H122A, BE4-RrA3F, BE4-AmAPOBEC1, and BE4-SsAPOBEC2) are replacements for previously published CBEs and provides solutions for potentially side-effects caused by harmful spurious deamination.

The canonical cytidine base editors (CBEs), base editor 3 (BE3), BE4, and BE4max contain an N-terminal cytidine deaminase rat APOBEC1 (rAPOBEC1). Other CBEs also use hAPOBEC3A, hAID, CDA1, and FENRY to perform the deamination of cytidine. rAPOBEC1 is the most widely used deaminase in CBEs due to an overall higher editing efficiency and relatively better specificity. However, a recent report showed that 20-fold more SNVs were identified in mouse embryo cells treated with BE3 compared to non-treated cells. Spurious C to T mutations were also detected in a BE3 treated rice genome, including genic regions. Additionally, two reports revealed that tens of thousands off-target edits were found in the transcriptome with a BE3 or BE4 treated sample. These studies together raise concerns about the safety of CBEs for potential therapeutic applications. The off-target editing at the DNA or RNA level was guide-independent and related to the intrinsic characteristics of deaminases instead of Cas9. Base editing uses Cas9 to search for the intended target site, however, the deaminase itself also binds to ssDNA and ssRNA independently. The 32 amino acid flexible linker between the deaminase and Cas9 is unlikely to be sufficient to position the deaminase perfectly towards its substrate. Since deaminase was recruited to the Cas9 target site and its local concentration was greatly increased, a lower binding affinity is likely to be sufficient for on-target editing compared to off-target editing. A strong ssDNA/ssRNA binding capability might be responsible for unguided off-target editing observed for CBE. It is necessary to engineer existing cytidine deaminases or search for new deaminases with a more favorable ssDNA binding and catalytical profile.

Figure 1B:
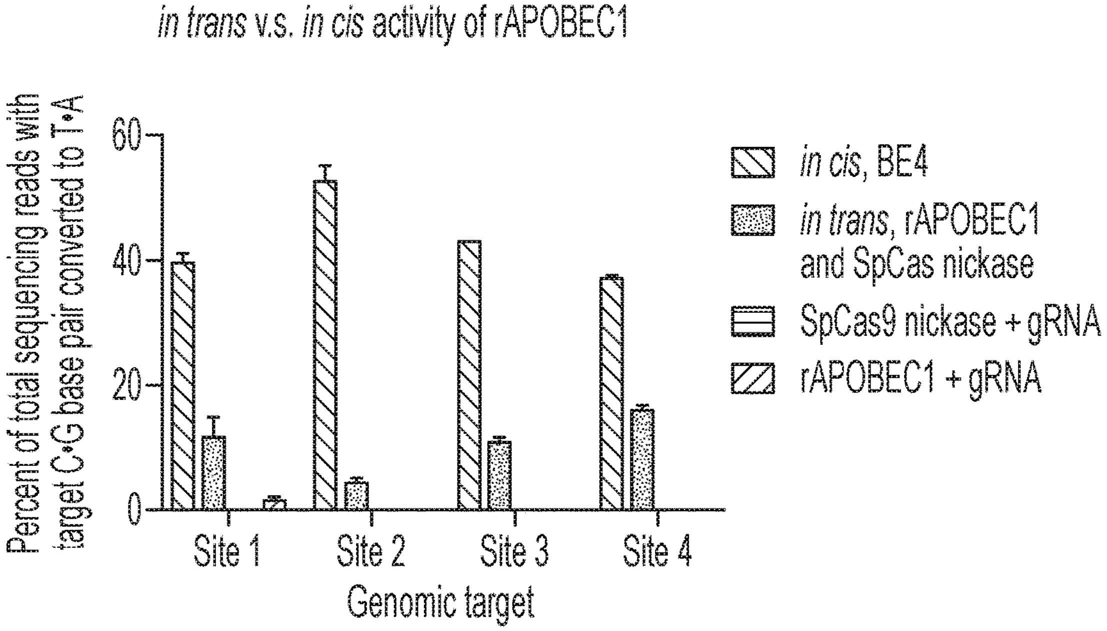
Figure 1C:
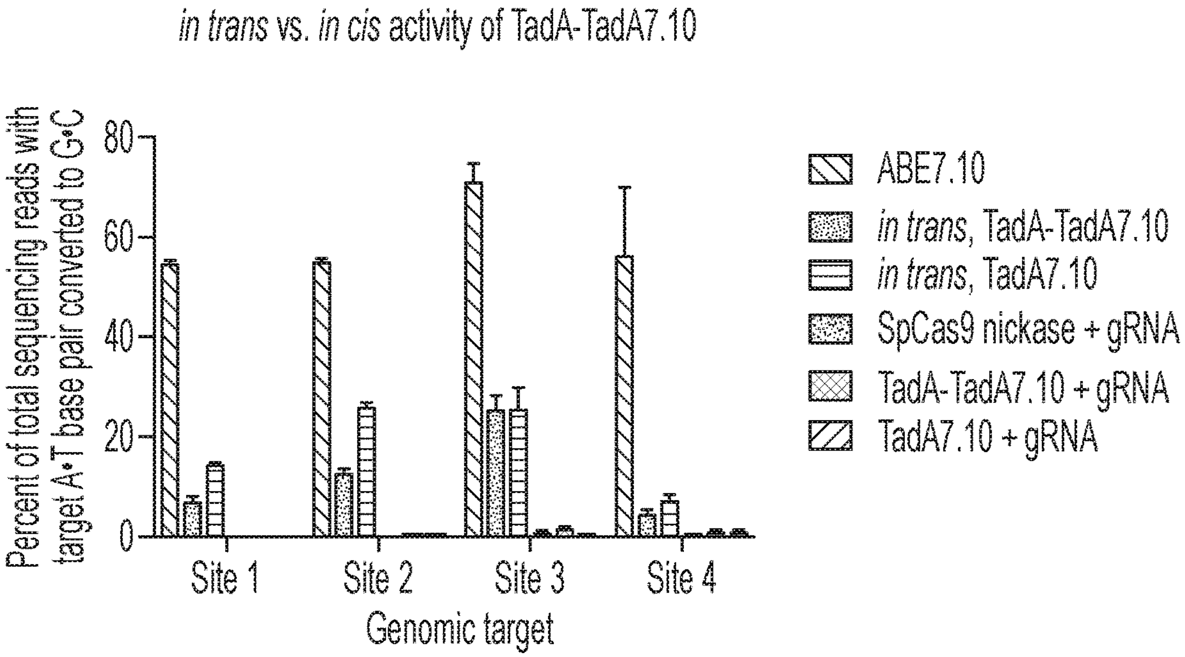
Figure 2A:
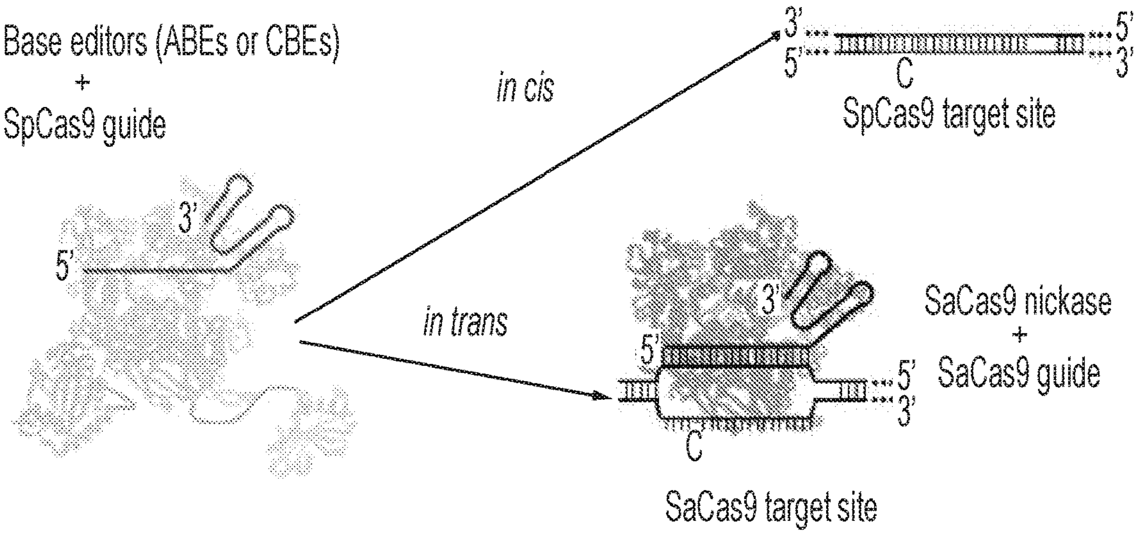
FIGS. 2A-2F depict a cis-trans assay for base editors, an illustration of a deaminase similarity network and and screening of 153 deaminases.
Figure 2B:
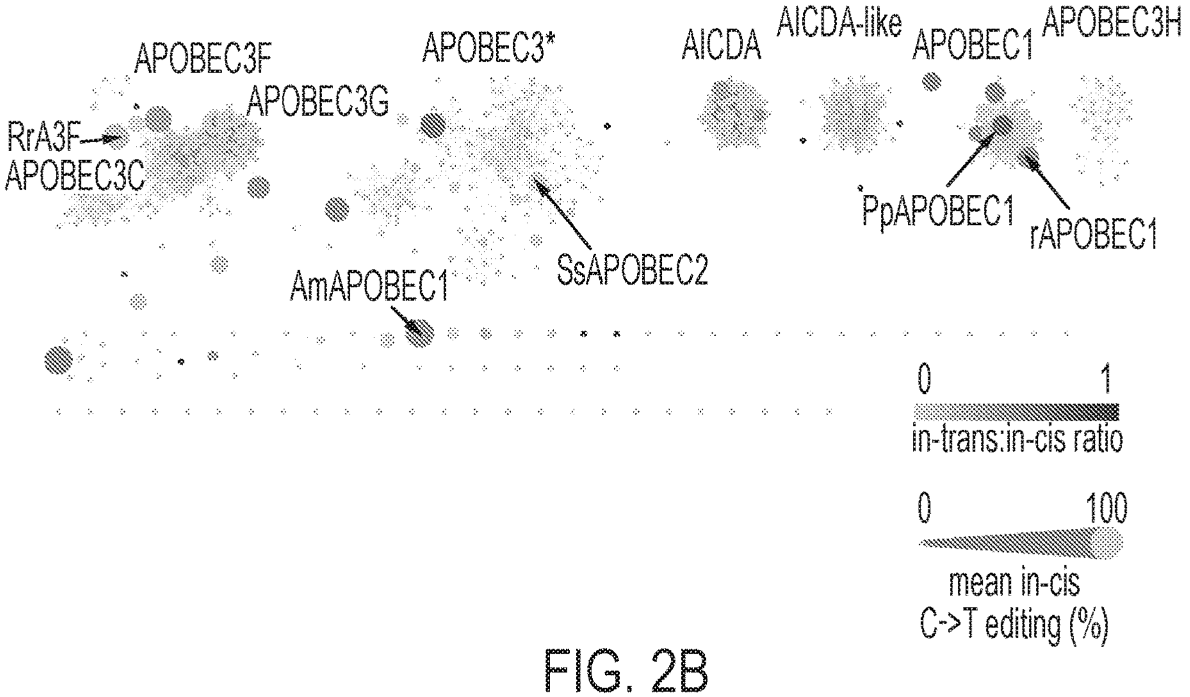
Figure 2C:
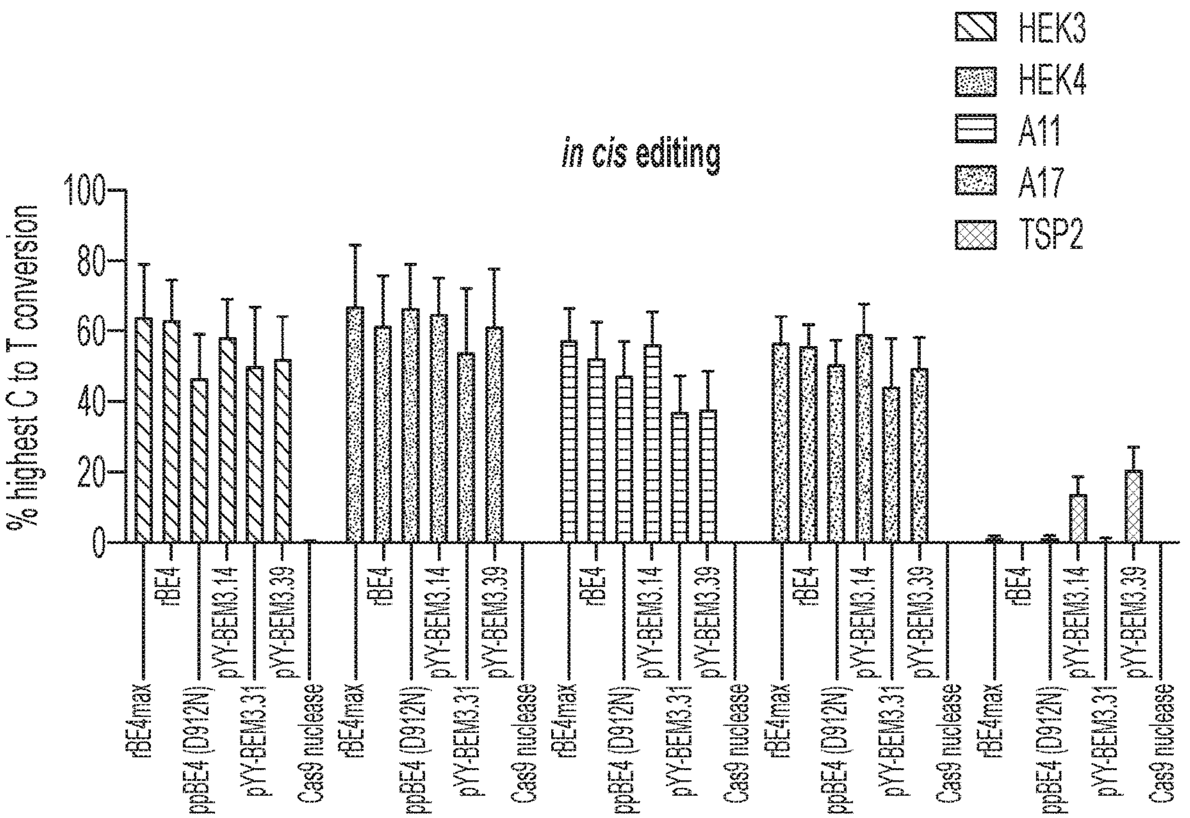
Figure 2D:
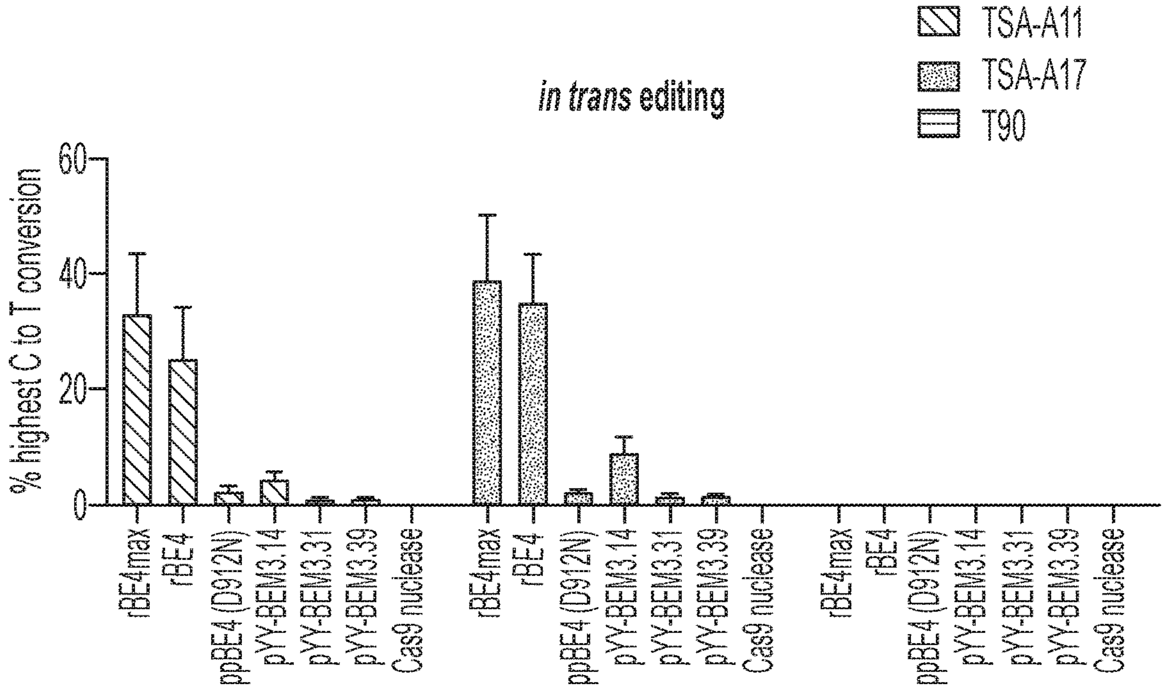
Figure 2E:
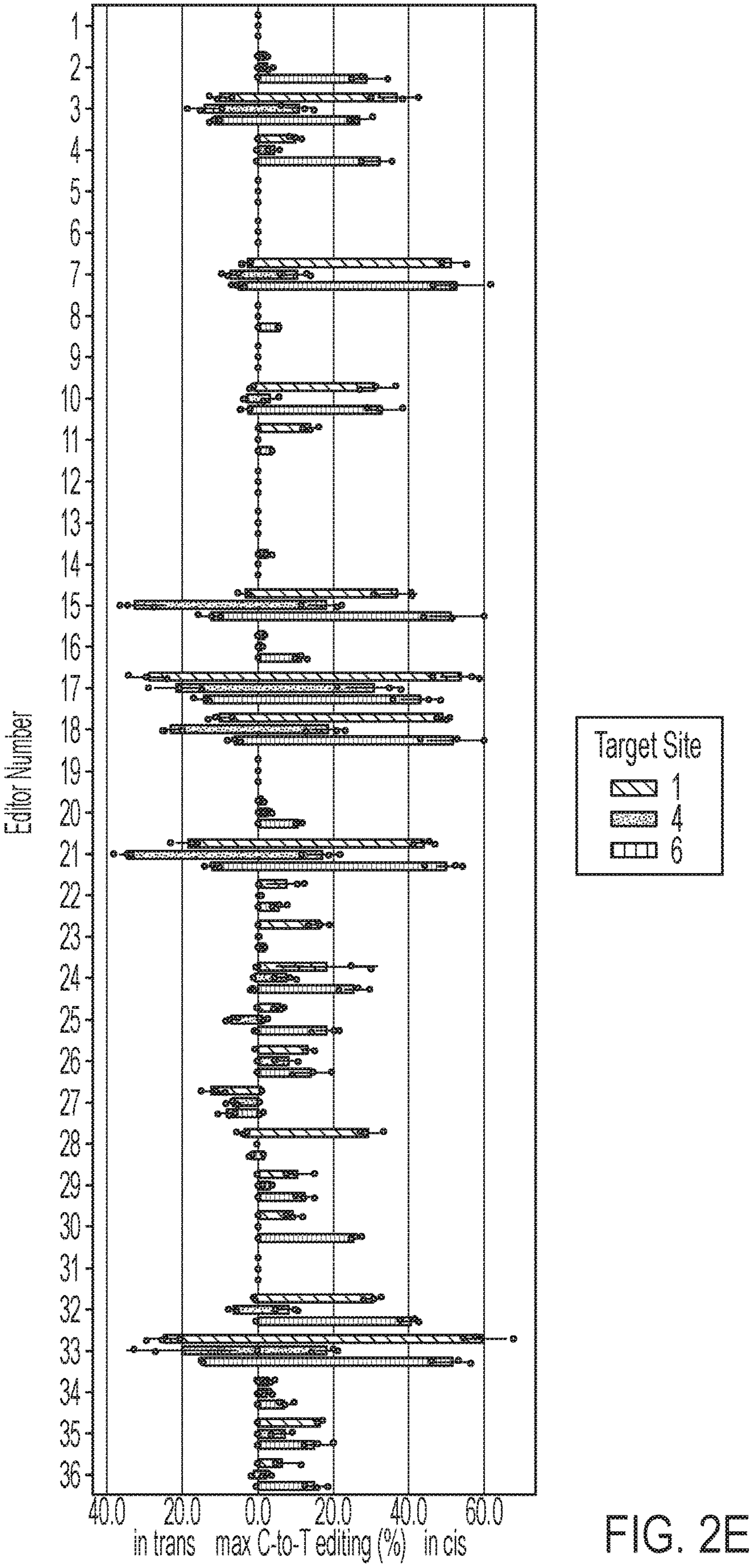
Figure 2F:
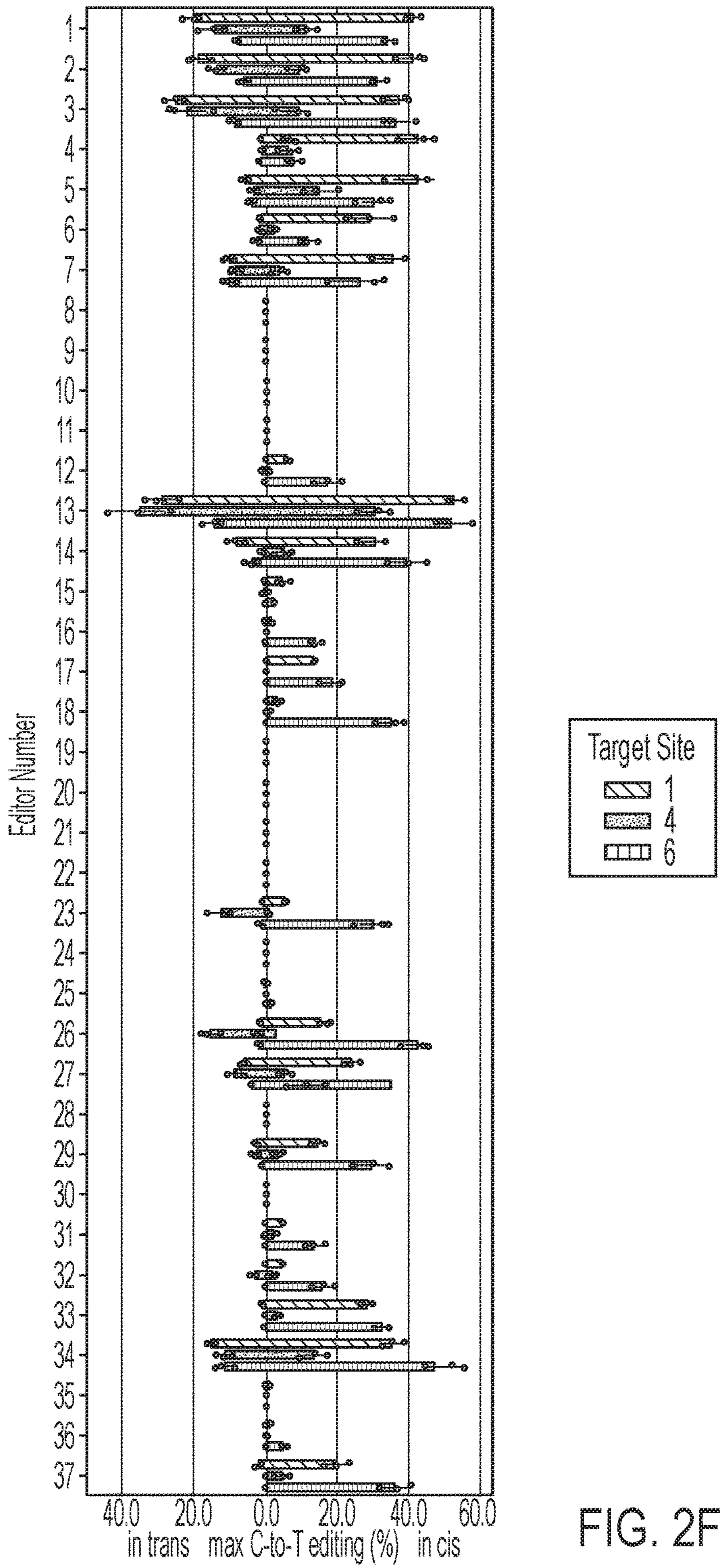
Figure 3A:
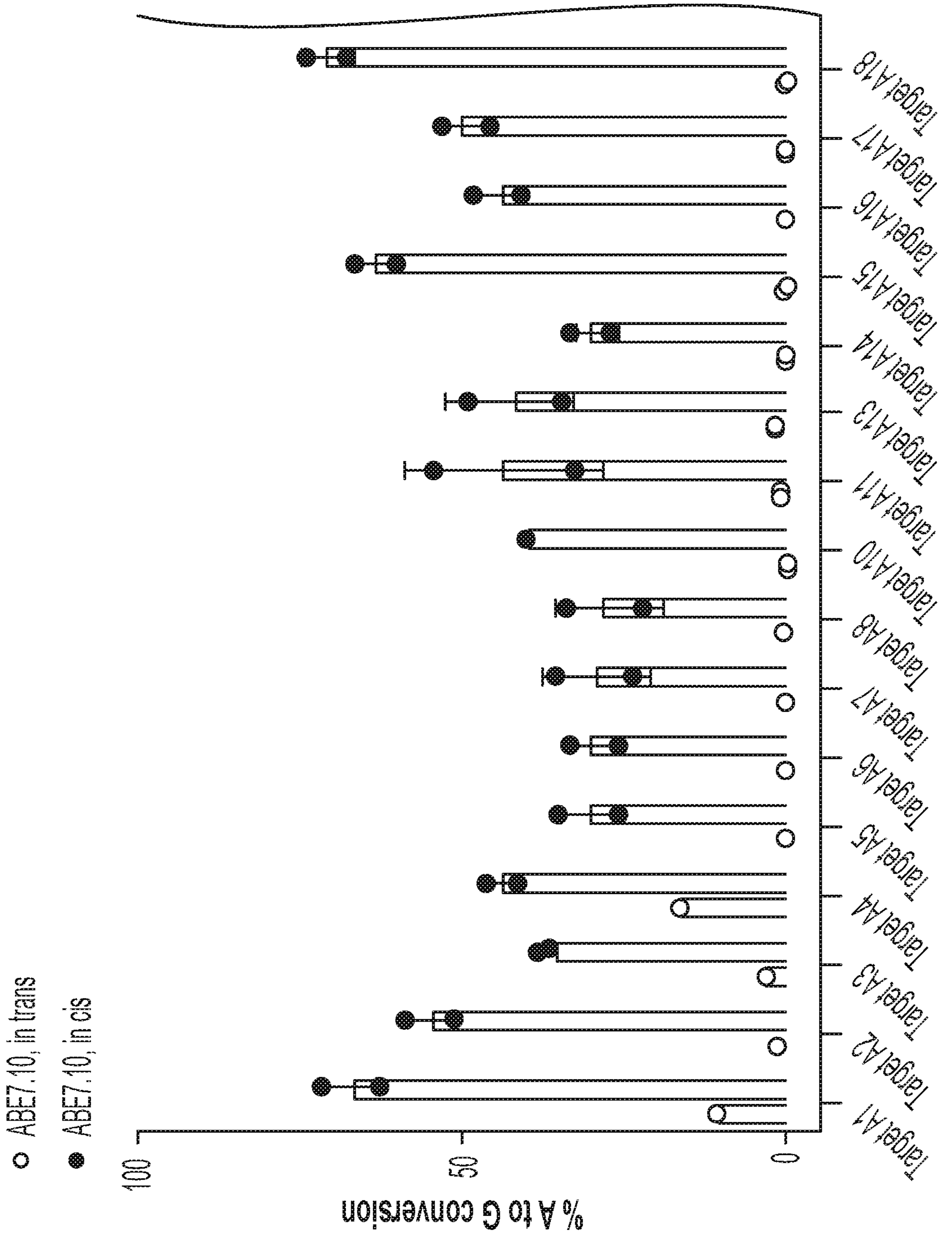
FIGS. 3A and 3B depict cis-trans activity.
Figure 3A:
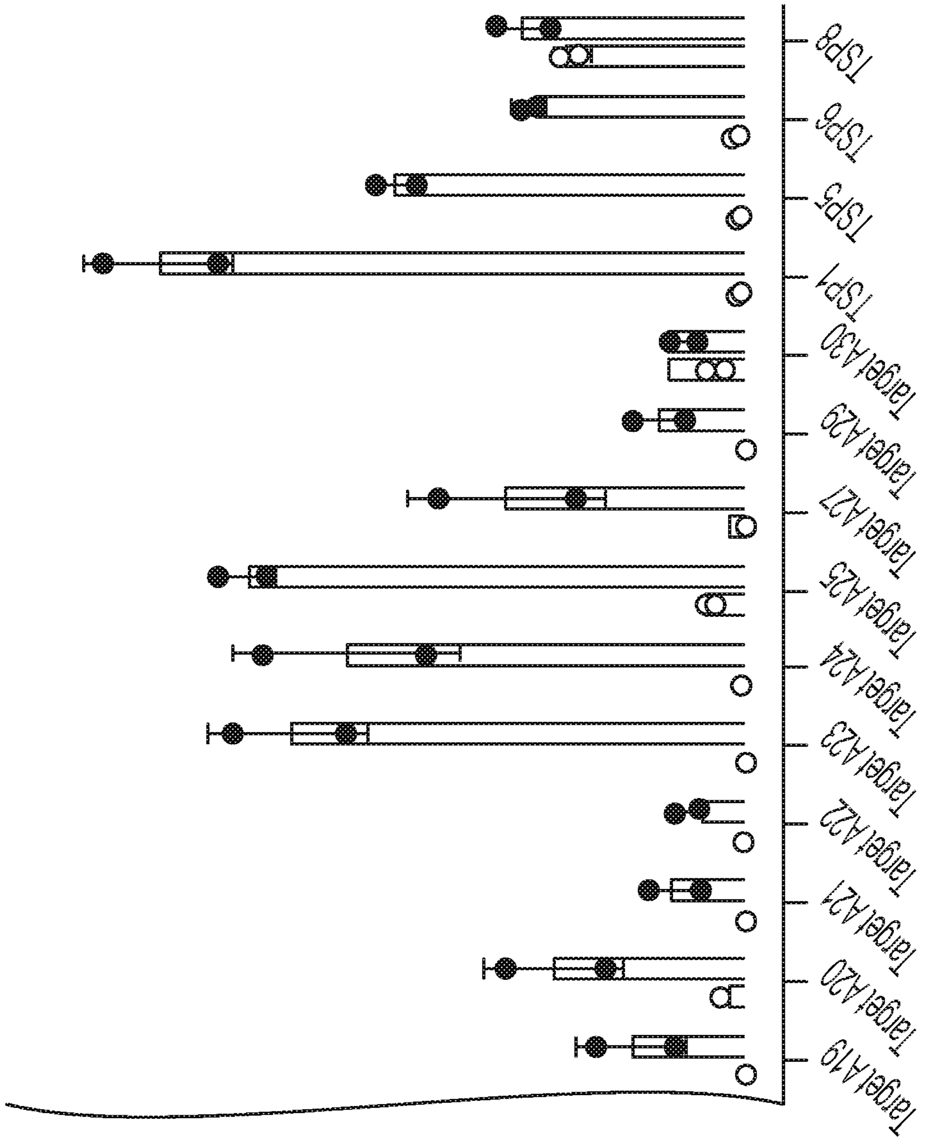
Figure 3B:
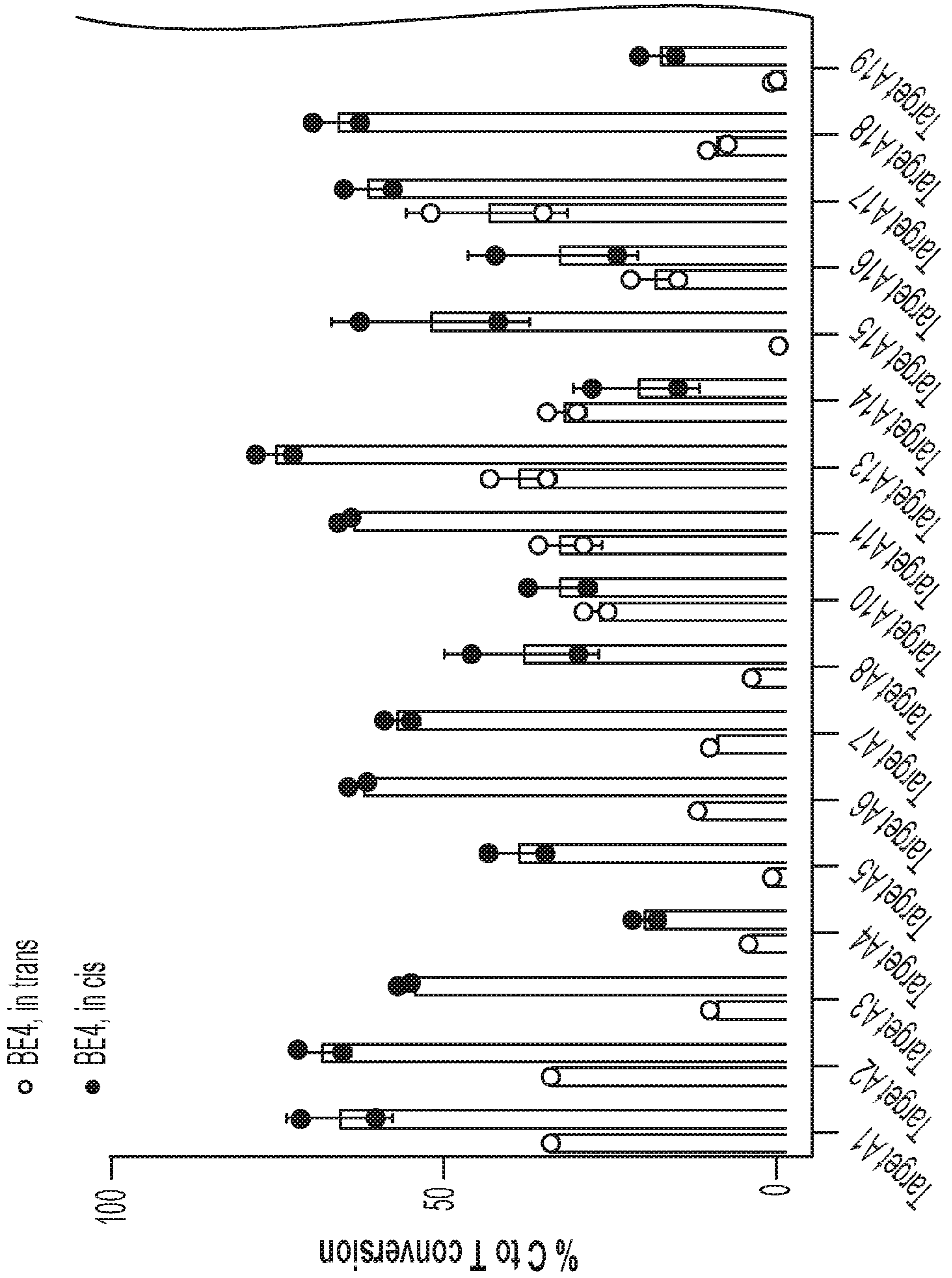
Figure 3B:
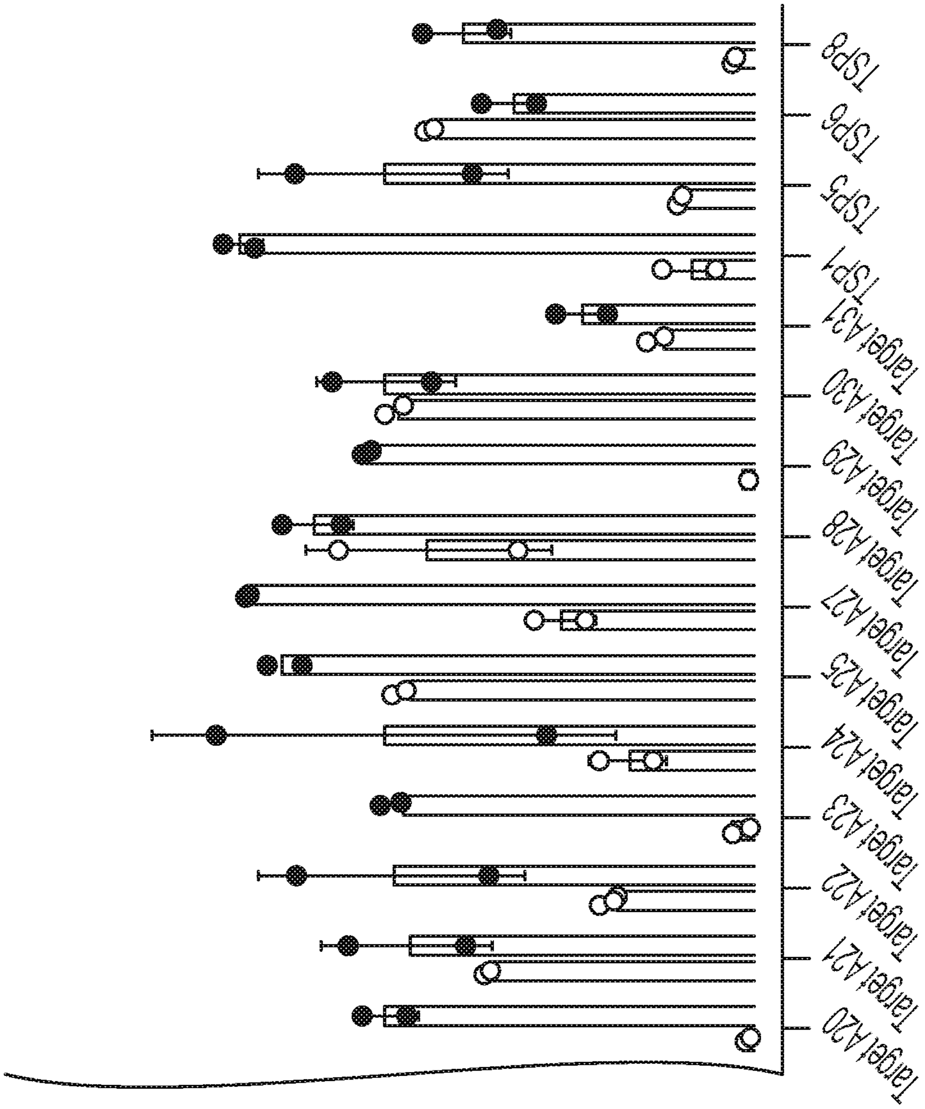
Figure 4A:
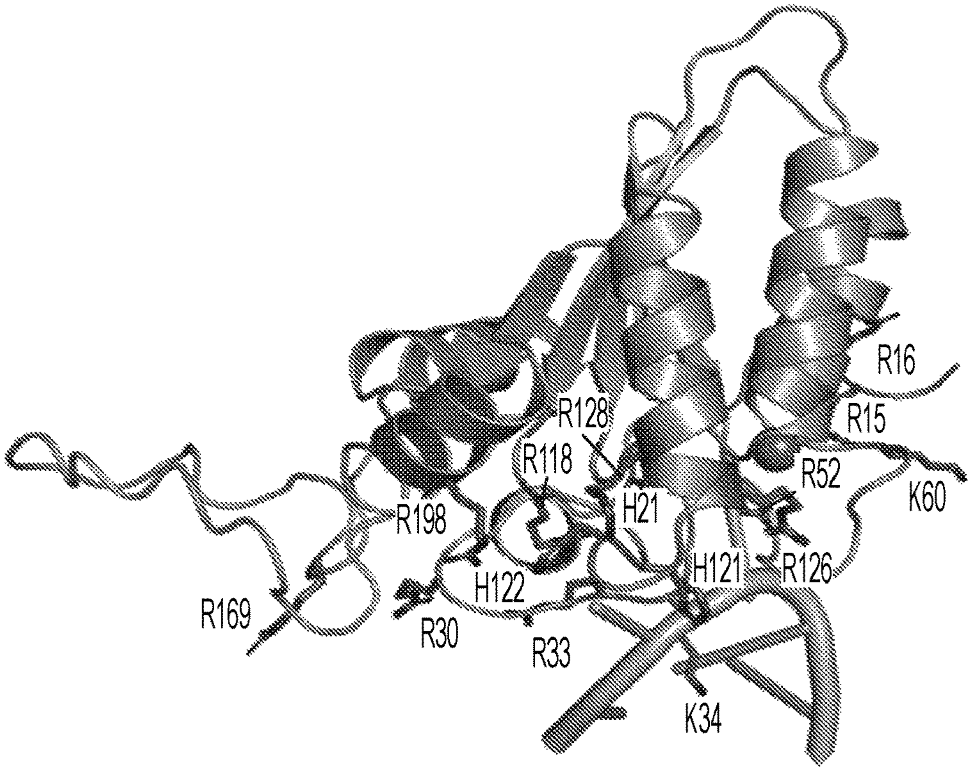
FIGS. 4A and 4B depict rAPOBEC1 homology models generated by SWISSMODEL using hAPOBEC3C structure (PDB ID 3VM8). ssDNA from hAPOBEC3A structure (PDB ID 5SWW) is manually docked.
Figure 4B:
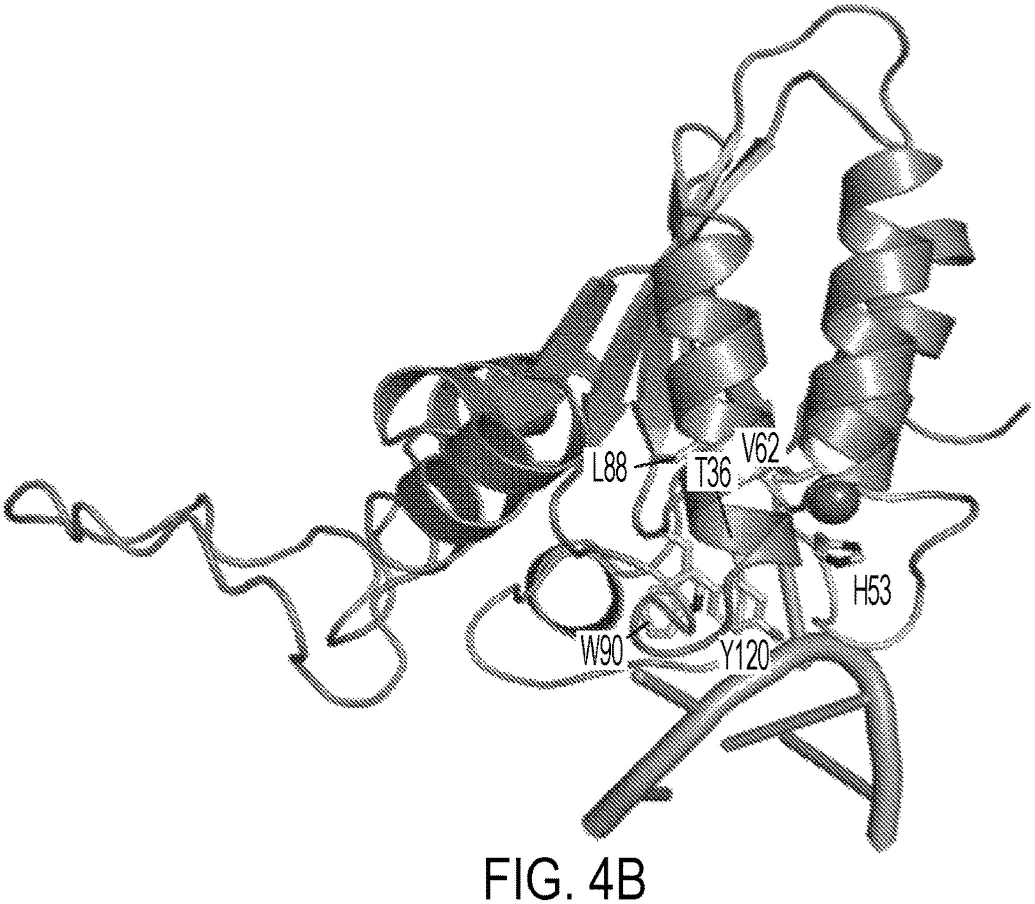
Figure 5A:
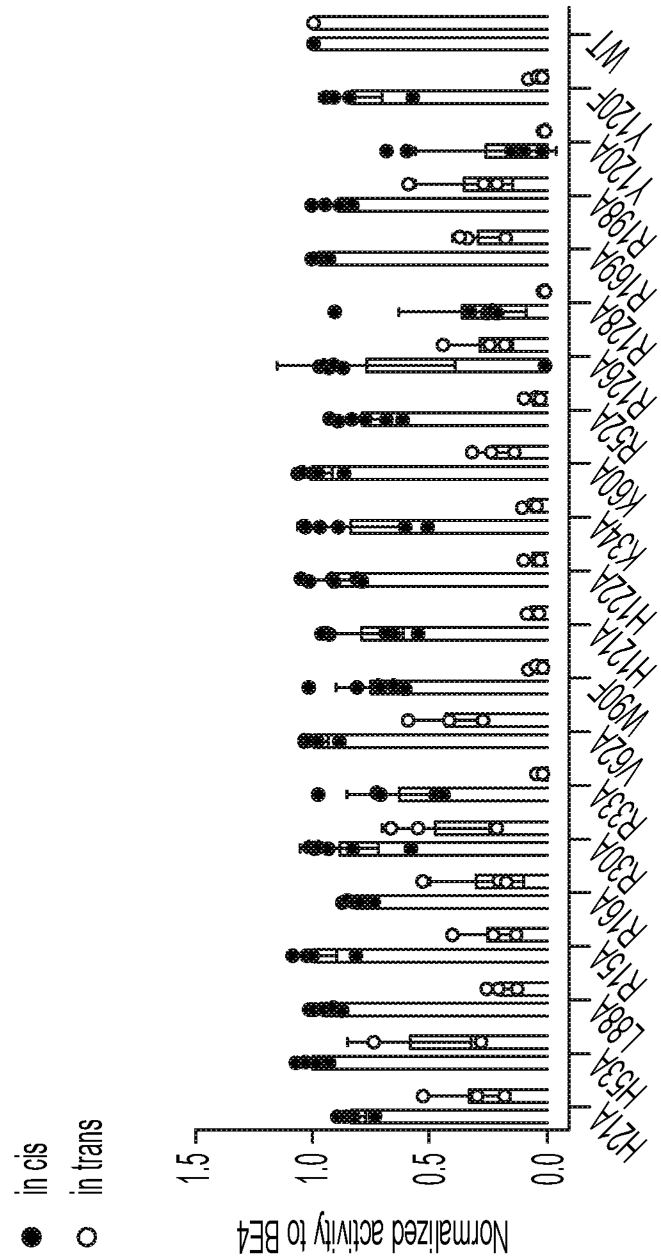
Figure 5B:
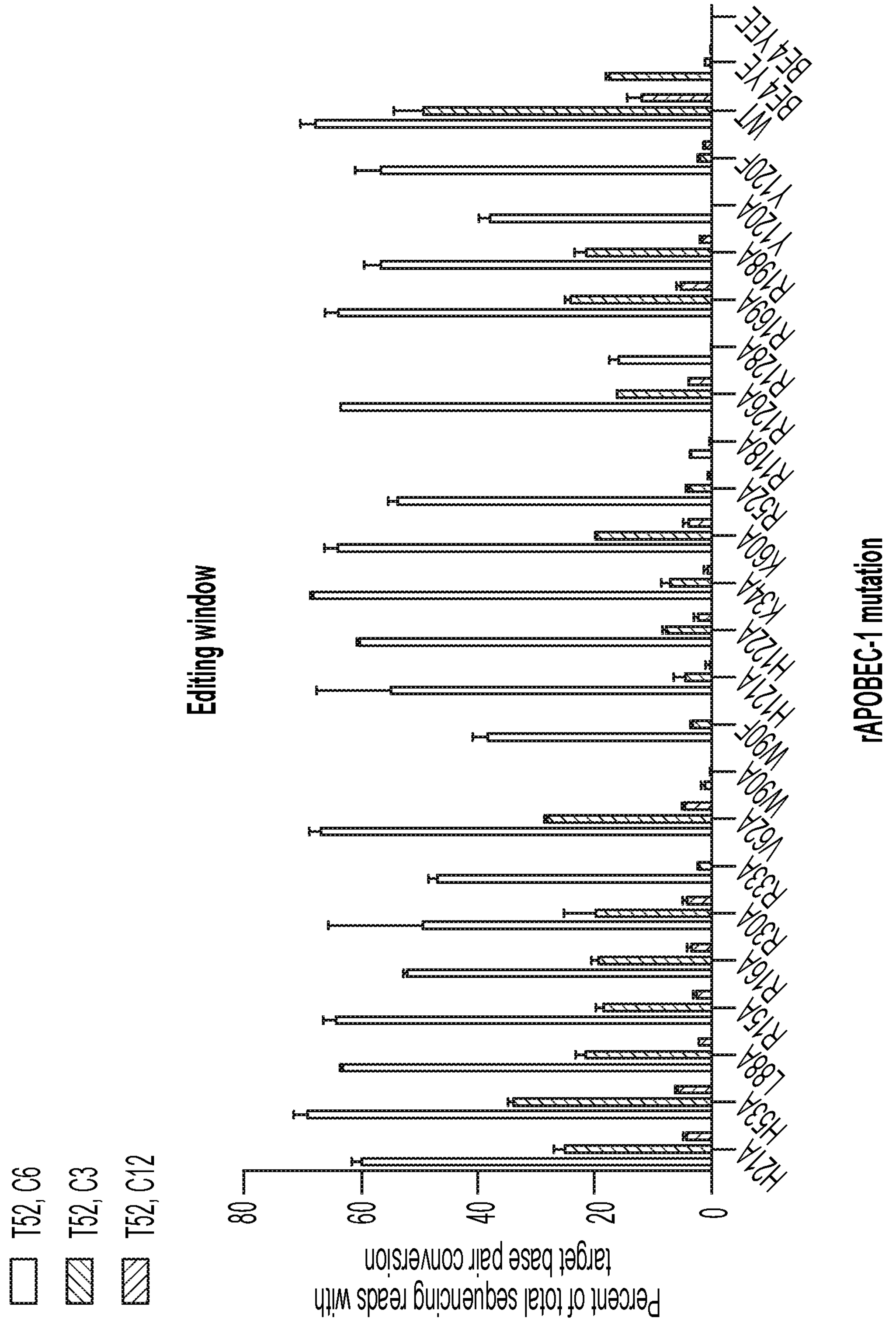
Figure 6A:
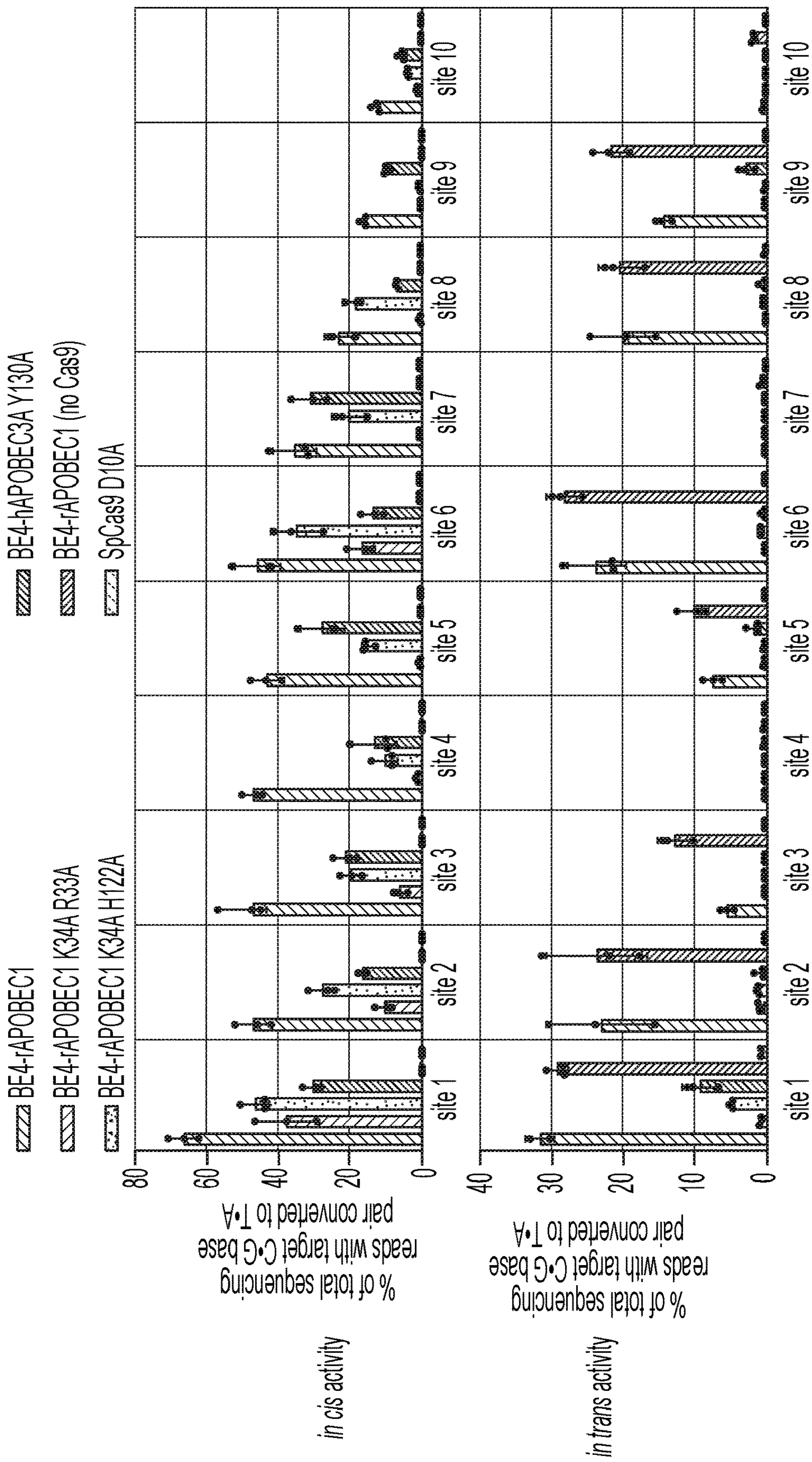
FIGS. 6A-6E depict cis-trans activity of rAPOBEC1 double mutants.
Figure 6B:
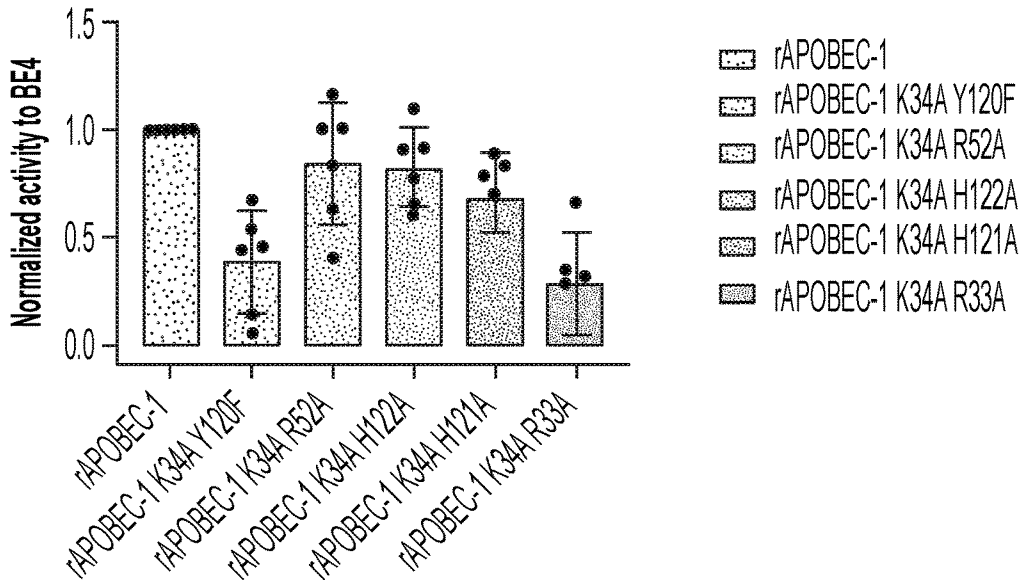
Figure 6C:
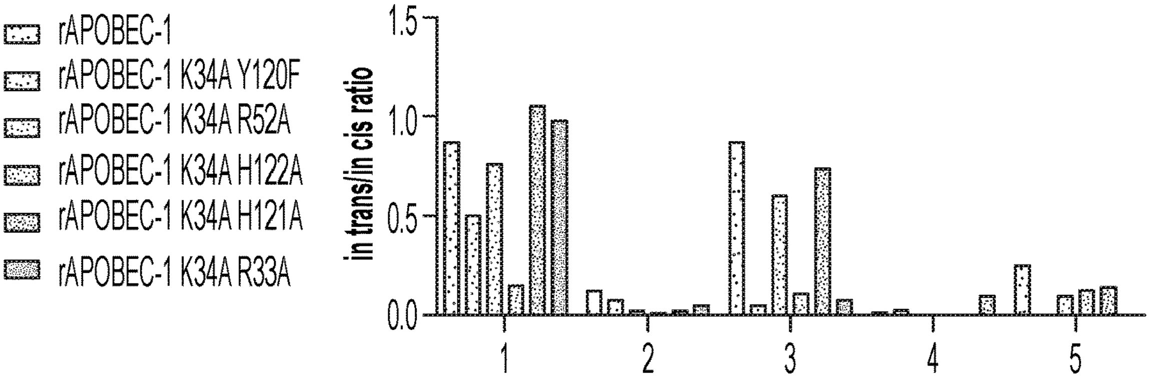
Figure 6D:
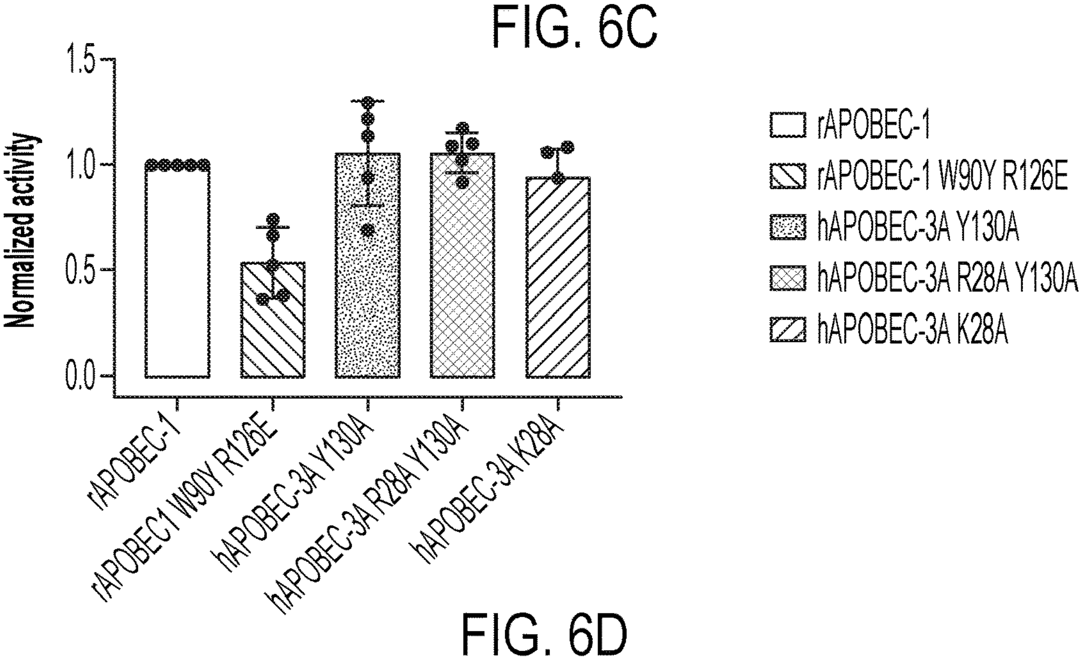
Figure 6E:
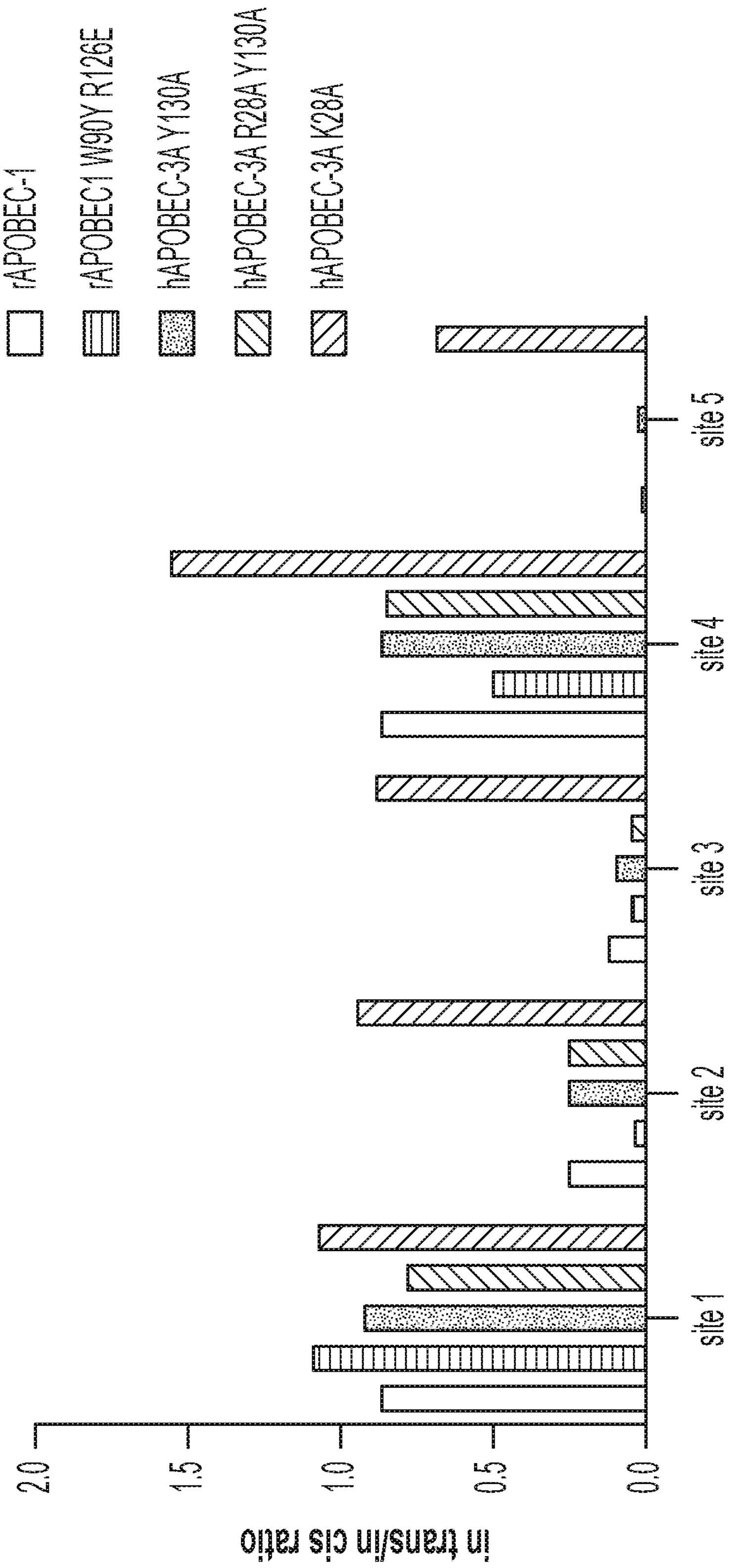

It has been reported that cytidine deaminases like APOBEC3A use ssDNA instead of dsDNA as substrate. It is likely that spurious deamination in the genome occurs when single-stranded DNA becomes transiently available during DNA replication or DNA transcription. There is no well-established assay for spurious deamination except for labor intensive whole genome sequencing. Therefore, to a high-throughput assay was established to evaluate guide-independent ssDNA deamination. *S. pyogenes* Cas9/gRNA complex was used to create an R-loop in the human genome and expose about a 20 nt Cas9 target site as single-strand DNA. Untethered rAPOBEC1 or Tad-TadA7.10 was co-transfected and deamination at the target sites was measured by NGS (FIGS. 1A-1C). Surprisingly, similar cis-trans ratios were observed for rAPOBEC1 and TadA7.10 monomer or heterodimer, which is not consistent with published whole genome sequencing data. The ability of deaminase to react on ssDNA substrate may have been alternated as the deaminase fusing to Cas9 in a base editor context. As a result, *S. aureus* Cas9/gRNA complex was used to create an R-loop at genomic target site and the in trans activity from the complete base editor was evaluated (FIG. 2A). In cis/in trans activity difference was observed in data generated based on in cis/in trans assay on three target sites, site 1, site 4, and site 6 with C base editors tested herein (FIG. 2E and FIG. 2F). A difference in the cis/trans ratio was observed at 34 genomic sites for ABE7.10 and BE4max (FIGS. 3A and 3B), suggesting this cis/trans assay can be used a valid proxy for measuring genome wide DNA spurious deamination.

rAPOBEC1 was engineered for reduced ssDNA binding activity. A homology model of rAPOBEC1, based on exiting hA3C crystal structure, was used to predict 15 mutations important for ssDNA binding and 8 mutations that affect catalytical activity (FIGS. 4A and 4B). All 23 mutations were tested in cis/trans assay and 7 high fidelity (HiFi) mutations were identified (R33A, W90F, K34A, R52A, H122A, H121A, Y120F) that reduced in trans activity without impairing in cis editing (FIG. 5A). A narrow editing window with less bystander editing was also observed at some target sites when these HiFi mutations were installed (FIG. 5B). Mutations of two residues (R128, W90) have been shown to be associated with a narrower editing window. Interestingly, a H122A mutation in BE4max also reversed the bias against GC motif (FIG. 5C). A study for continuous evolution of BE4 resulted in an editor with improved activity on GC motif, and H122L was one of the 5 mutations introduced. The H122 residue might be the key residue responsible for the change of substrate preference. A few studies showed installing certain mutations (R33A, K34A, W90F) in rAPOBEC1 region reduced the RNA spurious deamination activity of CBE. Since it is highly likely that ssDNA/ssRNA binding regions overlap to a large extent, all these results showed that mutations that reduce ssDNA/ssRNA binding can be used to reduce spurious DNA/RNA deamination.

However, all rAPOBEFC1 with HiFi mutations showed an overall decrease in in cis activity. rAPOBEC1 double mutants (K34A R33A, and W90A R126E), which were reported previously as solutions for spurious RNA deamination, showed a decrease in on-target editing for most target sties tested, which prevented them from being useful in therapeutic applications (FIGS. 6A-6E). rAPOBEC1 K34A H122A performed better than rAPOBEC1 K34A R33A, but up to 70% decrease in activity was observed for certain target sites. hA3A with Y130A and R28A mutations still showed high in trans activity, suggesting potential DNA off-target editing activity.

Figure 7A:
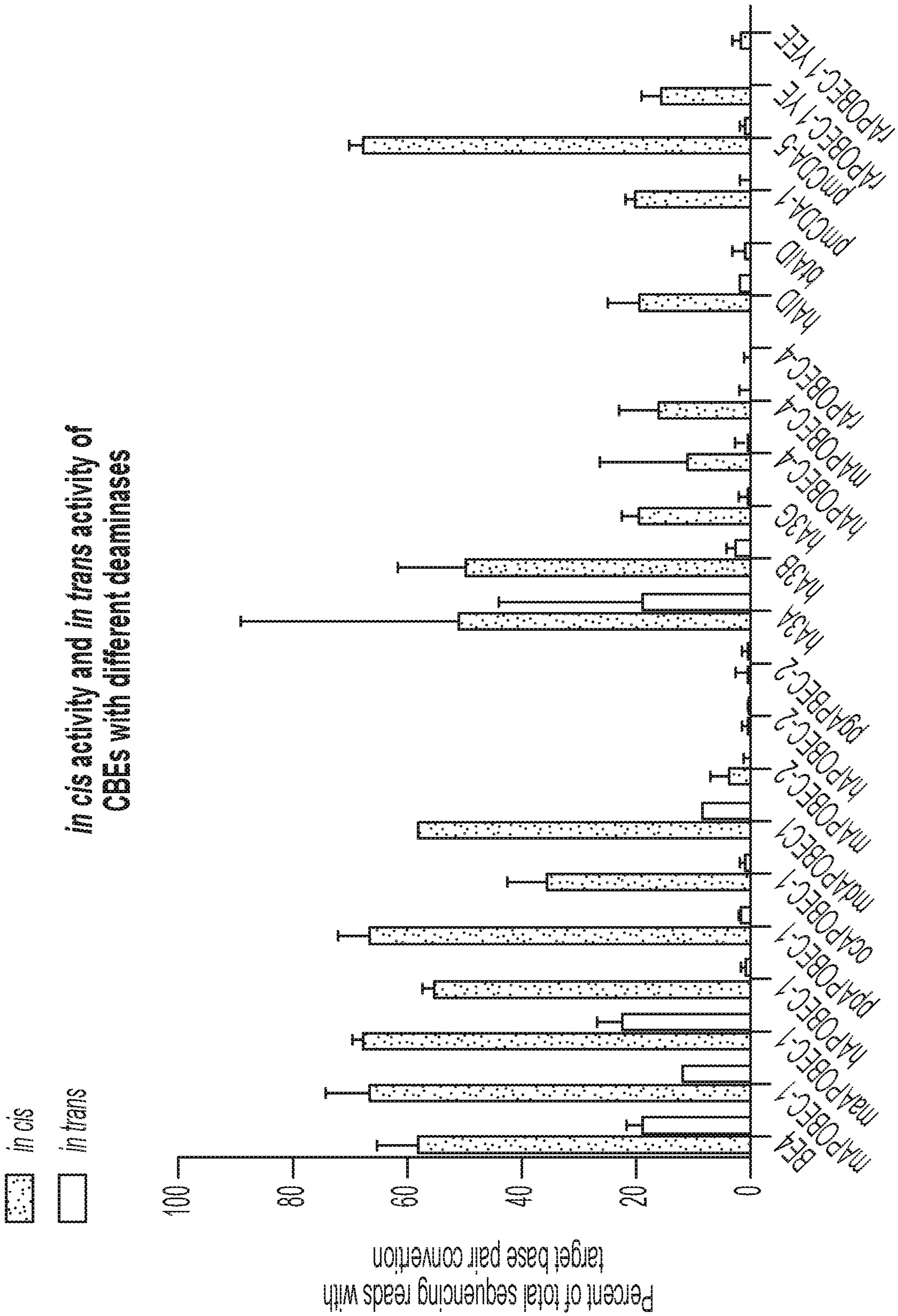
FIGS. 7A and 7B depict cis-trans activity of deaminases in first round of screening.
Figure 7B:
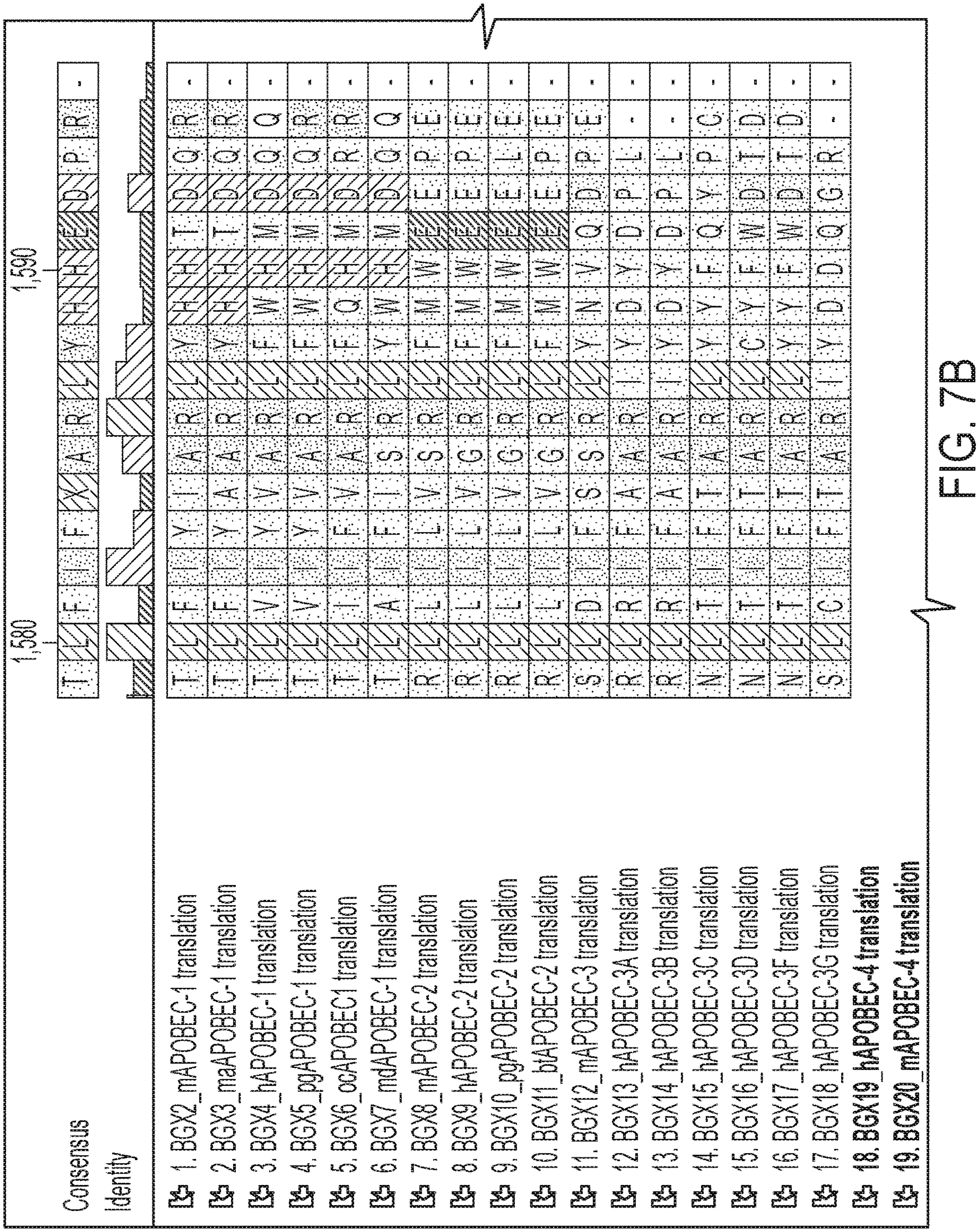
Figure 7B:
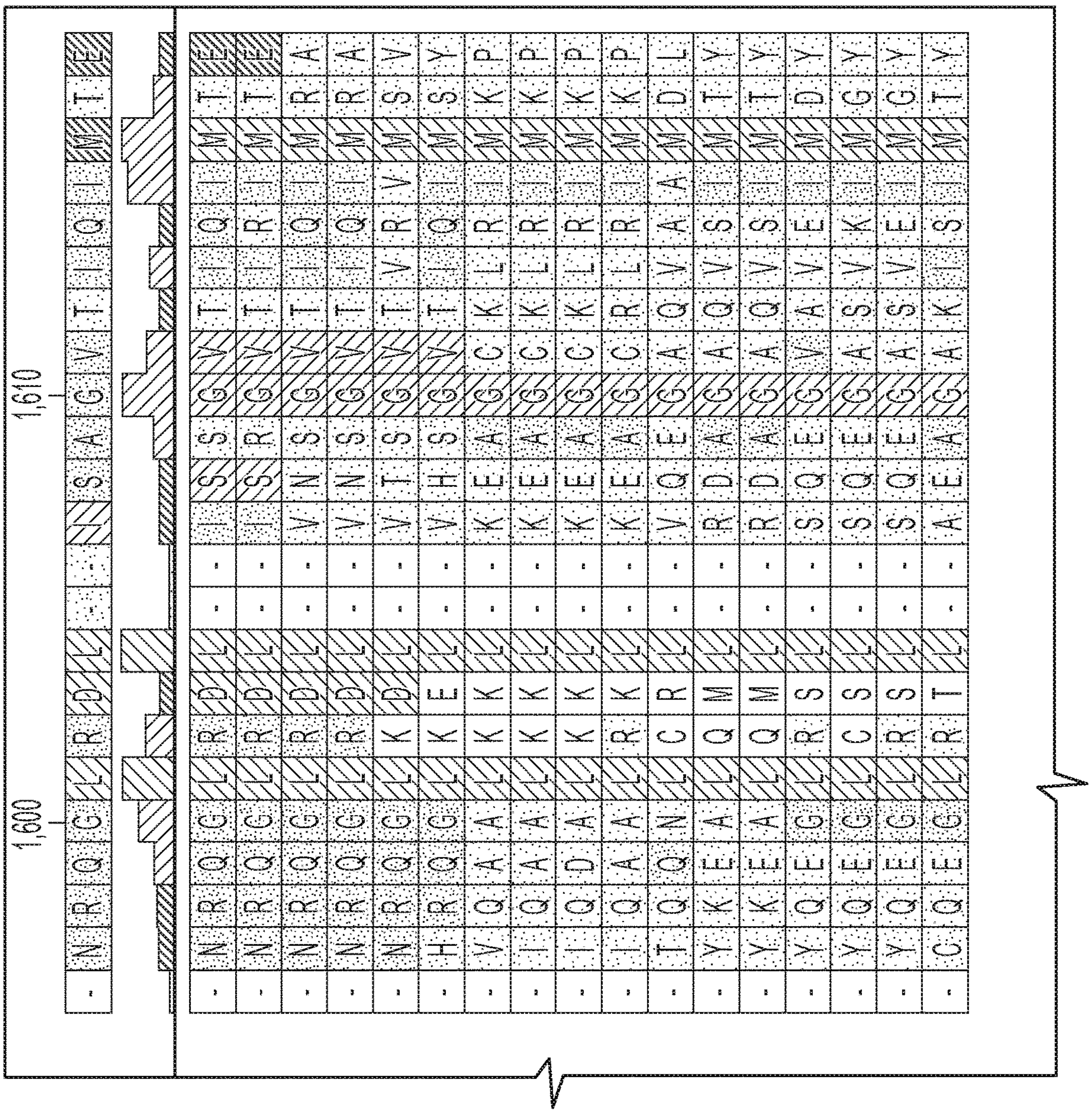
Figure 7B:
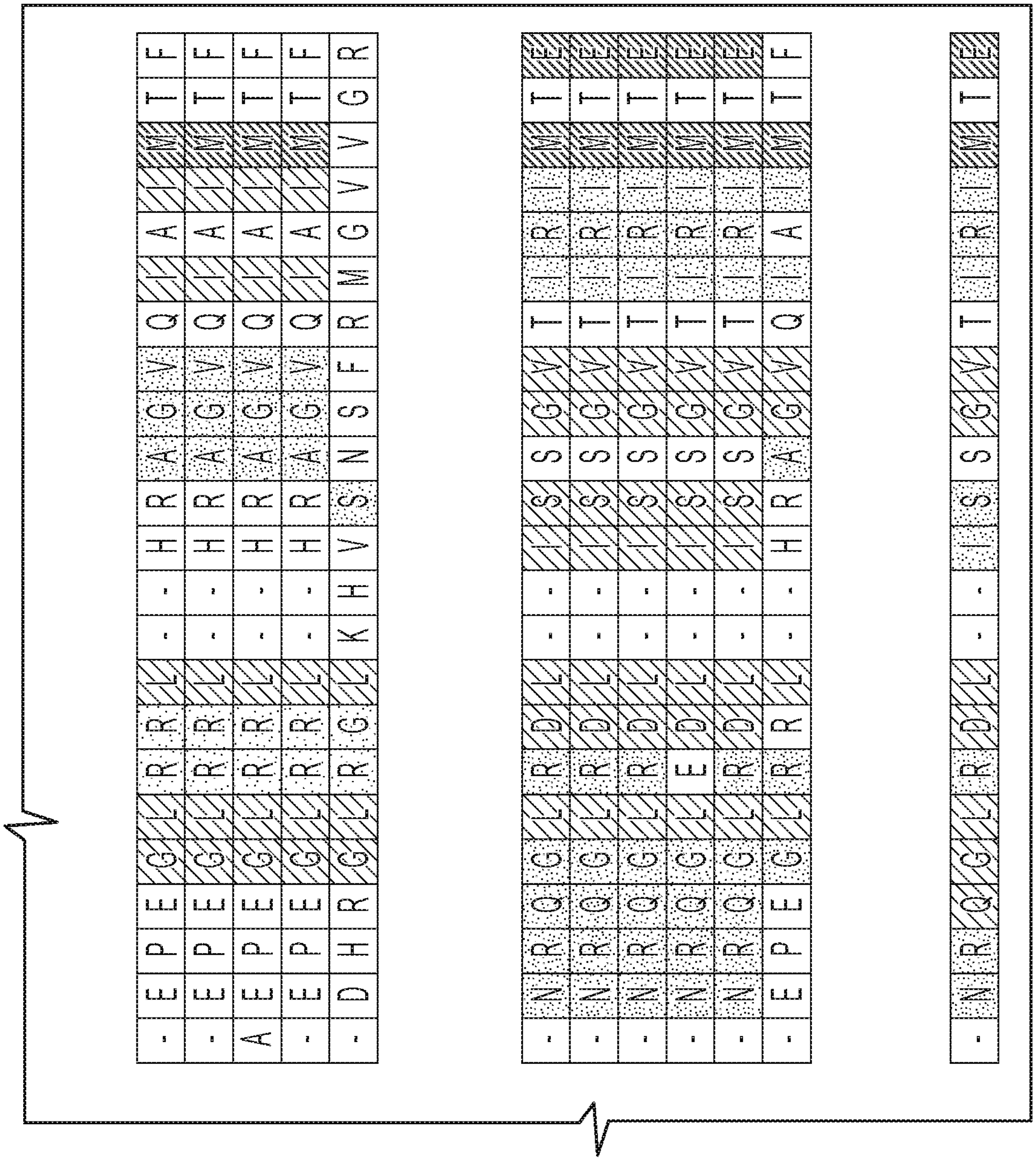
Figure 8A:
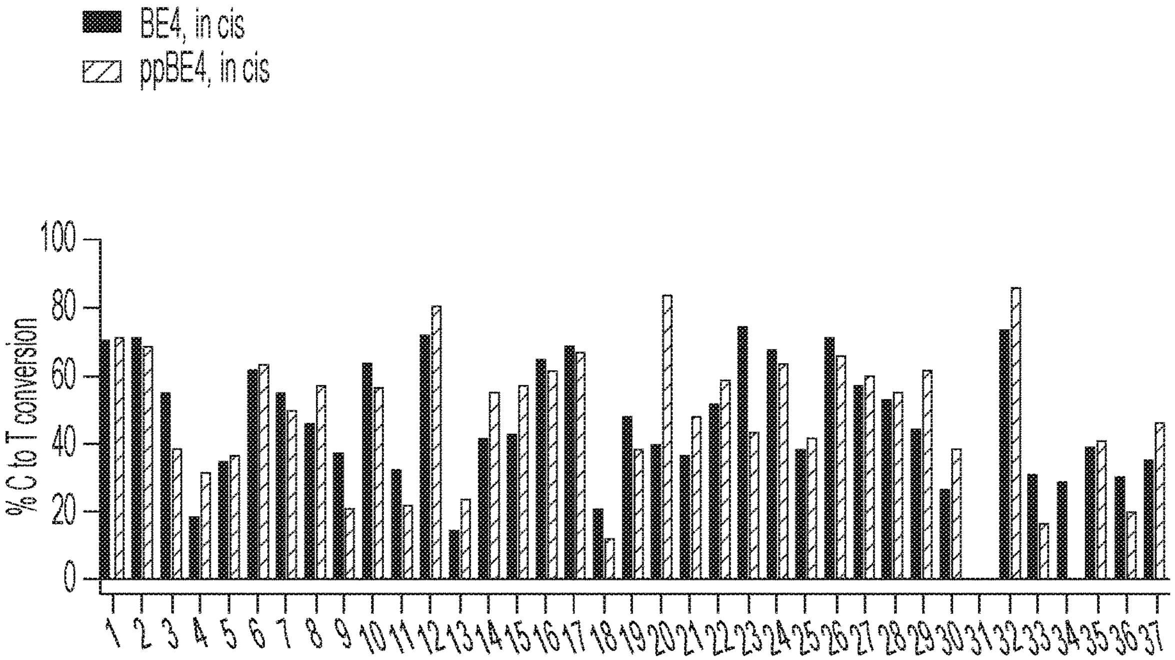
FIGS. 8A-8C are graphs depicting on target activity of ppAPOBEC1 versus rAPOBEC1.
Figure 8B:
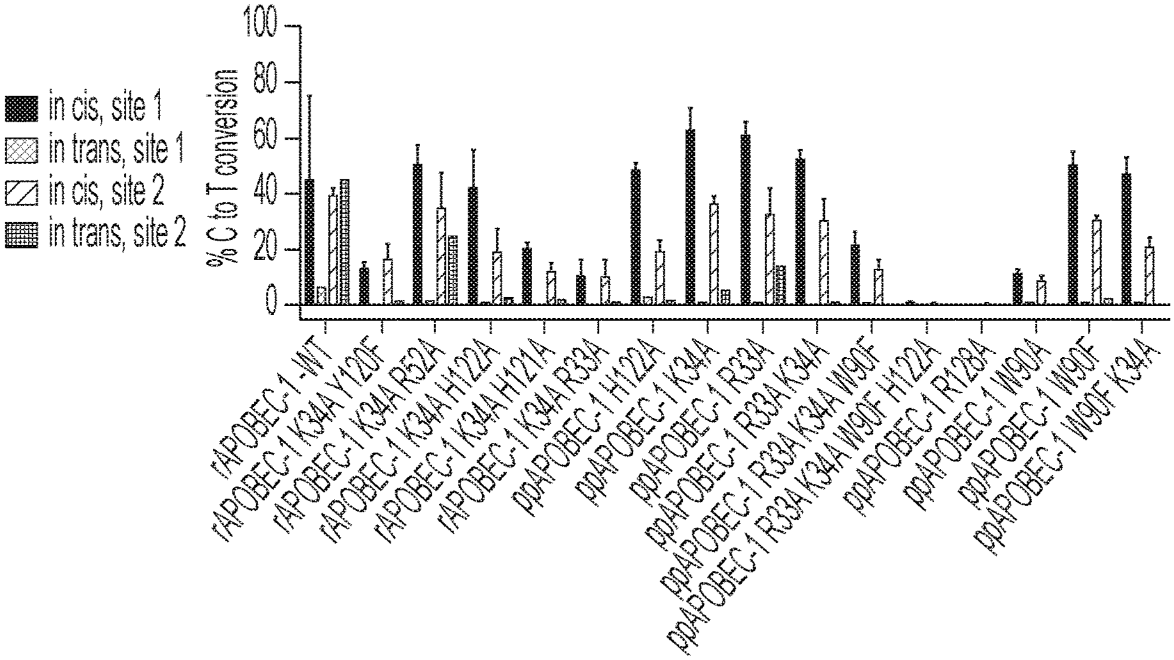
Figure 8C:
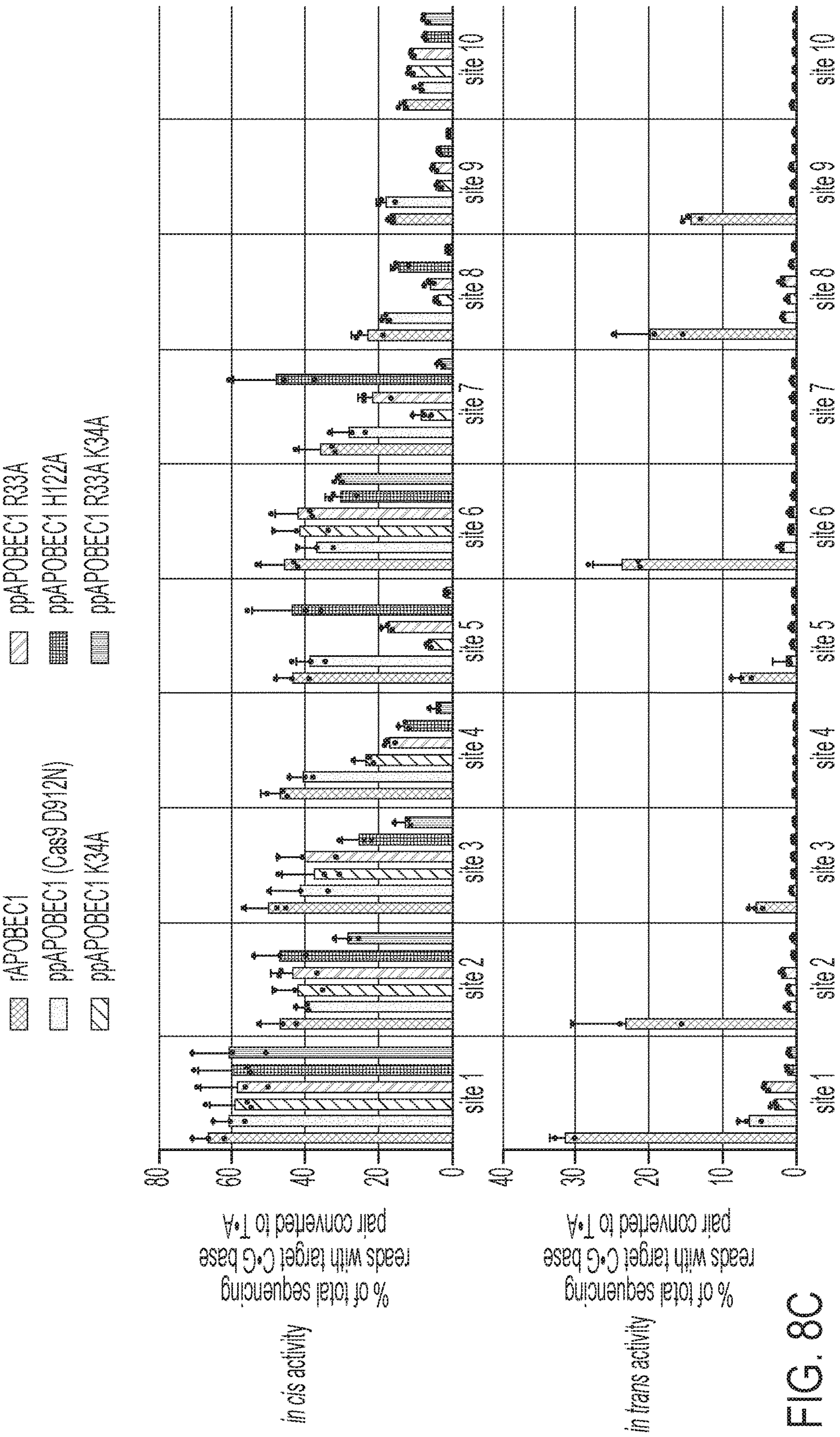
Figure 16:
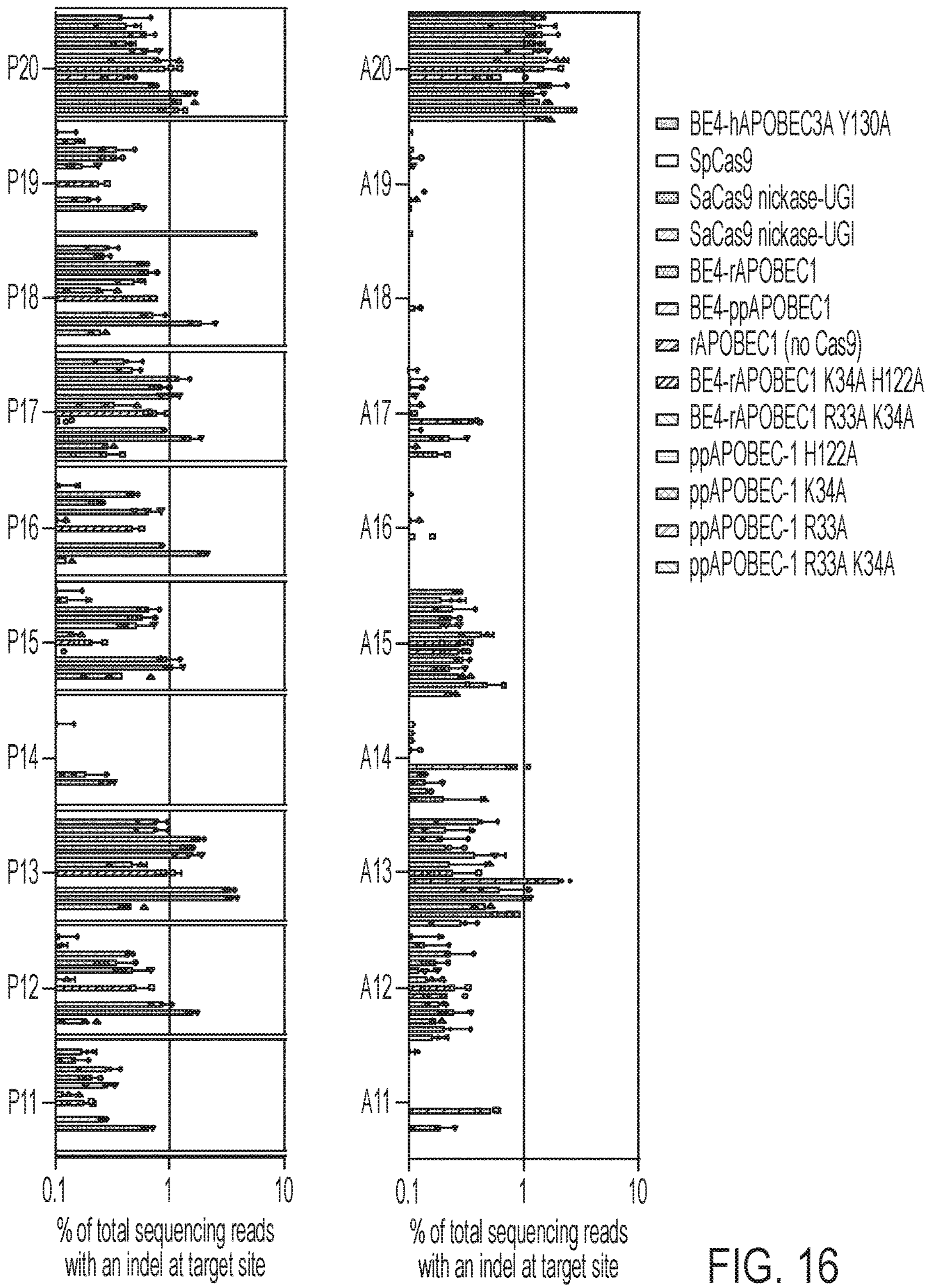
FIG. 16 is a graph depicting indel rate of selected CBEs at 10 target sites.

Since mutagenesis of available deaminases did not lead to efficient and safe editors, alternative deaminases that could be used for base editing were investigated. After an initial screening with a few members from characterized cytidine deaminase families like APOBEC1, APOBEC2, APOBEC3, APOBEC4, AID, CDA, etc, the APOBEC-like protein superfamily was identified. Amino acid sequences of all deaminases tested are provided in Table 13. Three APOBEC1s (hAPOBEC1, ppAPOBEC1, mdAPOBEC1) showed a high cis/trans ratio and all contained a Y120F mutation and other HiFi mutations at the corresponding positions (FIGS. 7A and 7B). On the other side, deaminases with high in trans activity (mAPOBEC1, maAPOBEC1, hA3A) all have tyrosine at this position. BE4 with ppAPOBEC1 showed similar on-target activity as rAPOBEC1 across 30 target sites tested (FIGS. 8A-8C). Table 14 shows the DNA sequence of all target sites tested. ppAPOBEC1 shared 68% sequence identify as rAPOBEC1, but unlike rAPOBEC1, HiFi mutations in ppAPOBEC1 were well-tolerated. CBEs with ppAPOBEC1 mutants display desirable editing profiles (FIGS. 8A-8C). Indel rates of selected CBEs at ten target sites are shown in FIG. 16.

TABLE 13

| Amino acid sequences of deaminases | | | |
|---|---|---|---|
| SEQ ID NO: | Gene name | Species | Sequences |
| 1 | rAPOBEC-1 | *Rattus norvegicus* | MSSETGPVAVDPTLRRRIEPHEFEVFFDPRELRKETCLLYEI NWGGRHSIWRHTSQNTNKHVEVNFIEKFTTERYFCPNTRCSI TWFLSWSPCGECSRAITEFLSRYPHVTLFIYIARLYHHADPR NRQGLRDLISSGVTIQIMTEQESGYCWRNFVNYSPSNEAHWP RYPHLWVRLYVLELYCIILGLPPCLNILRRKQPQLTFFTIAL QSCHYQRLPPHILWATGLK |
| 2 | mAPOBEC-1 | *Mus musculus* | MSSETGPVAVDPTLRRRIEPHEFEVFFDPRELRKETCLLYEI NWGGRHSVWRHTSQNTSNHVEVNFLEKFTTERYFRPNTRCSI TWFLSWSPCGECSRAITEFLSRHPYVTLFIYIARLYHHTDQR NRQGLRDLISSGVTIQIMTEQEYCYCWRNFVNYPPSNEAYWP RYPHLWVKLYVLELYCIILGLPPCLKILRRKQPQLTFFTITL QTCHYQRIPPHLLWATGLK |
| 3 | maAPOBEC-1 | *Mesocricetus auratus* | MSSETGPVVVDPTLRRRIEPHEFDAFFDQGELRKETCLLYEI RWGGRHNIWRHTGQNTSRHVEINFIEKFTSERYFYPSTRCSI VWFLSWSPCGECSKAITEFLSGHPNVTLFIYAARLYHHTDQR NRQGLRDLISRGVTIRIMTEQEYCYCWRNFVNYPPSNEVYWP RYPNLWMRLYALELYCIHLGLPPCLKIKRRHQYPLTFFRLNL QSCHYQRIPPHILWATGFI |
| 4 | hAPOBEC-1 | *Homo sapiens* | MTSEKGPSTGDPTLRRRIEPWEFDVFYDPRELRKEACLLYEI KWGMSRKIWRSSGKNTTNHVEVNFIKKFTSERDFHPSMSCSI TWFLSWSPCWECSQAIREFLSRHPGVTLVIYVARLF WHMDQQNRQGLRDLVNSGVTIQIMRASEYYHCWRNFVNYPPG DEAHWPQYPPLWMMLYALELHCIILSLPPCLKISRRWQNHLT FFRLHLQNCHYQTIPPHILLATGLIHPSVAWR |
| 5 | ppAPOBEC-1 | *Pongo pygmaeus* | MTSEKGPSTGDPTLRRRIESWEFDVFYDPRELRKETCLLYEI KWGMSRKIWRSSGKNTTNHVEVNFIKKFTSERRFHSSISCSI TWFLSWSPCWECSQAIREFLSQHPGVTLVIYVARLFWHMDQR NRQGLRDLVNSGVTIQIMRASEYYHCWRNFVNYPPGDEAHWP QYPPLWMMLYALELHCIILSLPPCLKISRRWQNHLAFFRLHL QNCHYQTIPPHILLATGLIHPSVTWR |
| 6 | ocAPOBEC1 | *Oryctolagus cuniculus* | MASEKGPSNKDYTLRRRIEPWEFEVFFDPQELRKEACLLYEI KWGASSKTWRSSGKNTTNHVEVNFLEKLTSEGRLGPSTCCSI TWFLSWSPCWECSMAIREFLSQHPGVTLIIFVARLFQHMDRR NRQGLKDLVTSGVTVRVMSVSEYCYCWENFVNYPPGKAAQWP RYPPRWMLMYALELYCIILGLPPCLKISRRHQKQLTFFSLTP QYCHYKMIPPYILLATGLLQPSVPWR |
| 7 | mdAPOBEC-1 | *Monodelphis domestica* | MNSKTGPSVGDATLRRRIKPWEFVAFFNPQELRKETCLLYEI KWGNQNIWRHSNQNTSQHAEINFMEKFTAERHFNSSVRCSIT WFLSWSPCWECSKAIRKFLDHYPNVTLAIFISRLYWHMDQQH RQGLKELVHSGVTIQIMSYSEYHYCWRNFVDYPQGEEDYWPK YPYLWIMLYVLELHCIILGLPPCLKISGSHSNQLALFSLDLQ DCHYQKIPYNVLVATGLVQPFVTWR |
| 8 | mAPOBEC-2 | *Mus musculus* | MAQKEEAAEAAAPASQNGDDLENLEDPEKLKELIDLPPFEIV TGVRLPVNFFKFQFRNVEYSSGRNKTFLCYVVEVQSKGGQAQ ATQGYLEDEHAGAHAEEAFFNTILPAFDPALKYNVTWYVSSS PCAACADRILKTLSKTKNLRLLILVSRLFMWEEPEVQAALKK LKEAGCKLRIMKPQDFEYIWQNFVEQEEGESKAFEPWEDIQE NFLYYEEKLADILK |
| 9 | hAPOBEC-2 | *Homo sapiens* | MAQKEEAAVATEAASQNGEDLENLDDPEKLKELIELPPFEIV TGERLPANFFKFQFRNVEYSSGRNKTFLCYVVEAQGKGGQVQ ASRGYLEDEHAAAHAEEAFFNTILPAFDPALRYNVTWYVSSS PCAACADRIIKTLSKTKNLRLLILVGRLFMWEEPEIQAALKK LKEAGCKLRIMKPQDFEYVWQNFVEQEEGESKAFQPWEDIQE NFLYYEEKLADILK |
| 10 | ppAPOBEC-2 | *Pongo pygmaeus* | MAQKEEAAAATEAASQNGEDLENLDDPEKLKELIELPPFEIV TGERLPANFFKFQFRNVEYSSGRNKTFLCYVVEAQGKGGQVQ ASRGYLEDEHAAAHAEEAFFNTILPAFDPALRYNVT WYVSSSPCAACADRIIKTLSKTKNLRLLILVGRLFMWEELEI QDALKKLKEAGCKLRIMKPQDFEYVWQNFVEQEEGESKAFQP WEDIQENFLYYEEKLADILK |

TABLE 13-continued

| Amino acid sequences of deaminases | | | |
|---|---|---|---|
| SEQ ID NO: | Gene name | Species | Sequences |
| 11 | btAPOBEC-2 | *Bos taurus* | MAQKEEAAAAAEPASQNGEEVENLEDPEKLKELIELPPFEIV TGERLPAHYFKFQFRNVEYSSGRNKTFLCYVVEAQSKGGQVQ ASRGYLEDEHATNHAEEAFFNSIMPTFDPALRYMVTWYVSSS PCAACADRIVKTLNKTKNLRLLILVGRLFMWEEPEIQAALRK LKEAGCRLRIMKPQDFEYIWQNFVEQEEGESKAFEPWEDIQE NFLYYEEKLADILK |
| 12 | mAPOBEC-3 | *Mus musculus* | MQPQRLGPRAGMGPFCLGCSHRKCYSPIRNLISQETFKFHFK NLGYAKGRKDTFLCYEVTRKDCDSPVSLHHGVFKNKDNIHAE ICFLYWFHDKVLKVLSPREEFKITWYMSWSPCFECAEQIVRF LATHHNLSLDIFSSRLYNVQDPETQQNLCRLVQEGAQVAAMD LYEFKKCWKKFVDNGGRRFRPWKRLLTNFRYQDSKLQEILRP CYISVPSSSSSTLSNICLTKGLPETRFWVEGRRMDPLSEEEF YSQFYNQRVKHLCYYHRMKPYLCYQLEQFNGQAPLKGCLLSE KGKQHAEILFLDKIRSMELSQVTITCYLTWSPCPNCAWQLAA FKRDRPDLILHIYTSRLYFHWKRPFQKGLCSLWQSGILVDVM DLPQFTDCWTNFVNPKRPFWPWKGLEIISRRTQRRLRRIKES WGLQDLVNDFGNLQLGPPMS |
| 13 | hAPOBEC-3A | *Homo sapiens* | MEASPASGPRHLMDPHIFTSNFNNGIGRHKTYLCYEVERLDN GTSVKMDQHRGFLHNQAKNLLCGFYGRHAELRFLDLVPSLQL DPAQIYRVTWFISWSPCFSWGCAGEVRAFLQENTHVRLRIFA ARIYDYDPLYKEALQMLRDAGAQVSIMTYDEFKHCWDTFVDH QGCPFQPWDGLDEHSQALSGRLRAILQNQGN |
| 14 | hAPOBEC-3B | *Homo sapiens* | MNPQIRNPMERMYRDTFYDNFENEPILYGRSYTWLCYEVKIK RGRSNLLWDTGVFRGQVYFKPQYHAEMCFLSWFCGNQLPAYK CFQITWFVSWTPCPDCVAKLAEFLSEHPNVTLTISAARLYYY WERDYRRALCRLSQAGARVTIMDYEEFAYCWENFVYNEGQQF MPWYKFDENYAFLHRTLKEILRYLMDPDTFTFNFNNDPLVLR RRQTYLCYEVERLDNGTWVLMDQHMGFLCNEAKNLLCGFYGR HAELRFLDLVPSLQLDPAQIYRVTWFISWSPCFSWGCAGEVR AFLQENTHVRLRIFAARIYDYDPLYKEALQMLRDAGAQVSIM TYDEFEYCWDTFVYRQGCPFQPWDGLEEHSQALSGRLRAILQ NQGN |
| 15 | hAPOBEC-3C | *Homo sapiens* | MNPQIRNPMKAMYPGTFYFQFKNLWEANDRNETWLCFTVEGI KRRSVVSWKTGVFRNQVDSETHCHAERCFLSWFCDDILSPNT KYQVTWYTSWSPCPDCAGEVAEFLARHSNVNLTIFTARLYYF QYPCYQEGLRSLSQEGVAVEIMDYEDFKYCWENFVYNDNEPF KPWKGLKTNFRLLKRRLRESLQ |
| 16 | hAPOBEC-3D | *Homo sapiens* | MNPQIRNPMERMYRDTFYDNFENEPILYGRSYTWLCYEVKIK RGRSNLLWDTGVFRGPVLPKRQSNHRQEVYFRFENHAEMCFL SWFCGNRLPANRRFQITWFVSWNPCLPCVVKVTKFLAEHPNV TLTISAARLYYYRDRDWRWVLLRLHKAGARVKIMDYEDFAYC WENFVCNEGQPFMPWYKFDDNYASLHRTLKEILRNPMEAMYP HIFYFHFKNLLKACGRNESWLCFTMEVTKHHSAVFRKRGVFR NQVDPETHCHAERCFLSWFCDDILSPNTNYEVTWYTSWSPCP ECAGEVAEFLARHSNVNLTIFTARLCYFWDTDYQEGLCSLSQ EGASVKIMGYKDFVSCWKNFVYSDDEPFKPWKGLQTNFRLLK RRLREILQ |
| 17 | hAPOBEC-3F | *Homo sapiens* | MKPHFRNTVERMYRDTFSYNFYNRPILSRRNTVWLCYEVKTK GPSRPRLDAKIFRGQVYSQPEHHAEMCFLSWFCGNQLPAYKC FQITWFVSWTPCPDCVAKLAEFLAEHPNVTLTISAARLYYYW ERDYRRALCRLSQAGARVKIMDDEEFAYCWENFVYSEGQPFM PWYKFDDNYAFLHRTLKEILRNPMEAMYPHIFYFHFKNLRKA YGRNESWLCFTMEVVKHHSPVSWKRGVFRNQVDPETHCHAER CFLSWFCDDILSPNTNYEVTWYTSWSPCPECAGEVAEFLARH SNVNLTIFTARLYYFWDTDYQEGLRSLSQEGASVEIMGYKDF KYCWENFVYNDDEPFKPWKGLKYNFLFLDSKLQEILE |
| 18 | hAPOBEC-3G | *Homo sapiens* | MKPHFRNTVERMYRDTFSYNFYNRPILSRRNTVWLCYEVKTK GPSRPPLDAKIFRGQVYSELKYHPEMRFFHWFSKWRKLHRDQ EYEVTWYISWSPCTKCTRDMATFLAEDPKVTLTIFVARLYYF WDPDYQEALRSLCQKRDGPRATMKIMNYDEFQHCWSKFVYSQ RELFEPWNNLPKYYILLHIMLGEILRHSMDPPTFTFNFNNEP WVRGRHETYLCYEVERMHNDTWVLLNQRRGFLCNQAPHKHGF LEGRHAELCFLDVIPFWKLDLDQDYRVTCFTSWSPCFSCAQE MAKFISKNKHVSLCIFTARIYDDQGRCQEGLRTLAEAGAKIS IMTYSEFKHCWDTFVDHQGCPFQPWDGLDEHSQDLSGRLRAI LQNQEN |

TABLE 13-continued

Amino acid sequences of deaminases

| SEQ ID NO: | Gene name | Species | Sequences |
|---|---|---|---|
| 19 | hAPOBEC-4 | *Homo sapiens* | MEPIYEEYLANHGTIVKPYYWLSFSLDCSNCPYHIRTGEEAR VSLTEFCQIFGFPYGTTFPQTKHLTFYELKTSSGSLVQKGHA SSCTGNYIHPESMLFEMNGYLDSAIYNNDSIRHIILYSNNSP CNEANHCCISKMYNFLITYPGITLSIYFSQLYHTEMDFPASA WNREALRSLASLWPRVVLSPISGGIWHSVLHSFISGVSGSHV FQPILTGRALADRHNAYEINAITGVKPYFTDVLLQTKRNPNT KAQEALESYPLNNAFPGQFFQMPSGQLQPNLPPDLRAPVVFV LVPLRDLPPMHMGQNPNKPRNIVRHLNMPQMSFQETKDLGRL PTGRSVEIVEITEQFASSKEADEKKKKKGKK |
| 20 | mAPOBEC-4 | *Mus musculus* | MDSLLMKQKKFLYHFKNVRWAKGRHETYLCYVVKRRDSATSC SLDFGHLRNKSGCHVELLFLRYISDWDLDPGRCYRVTWFTSW SPCYDCARHVAEFLRWNPNLSLRIFTARLYFCEDRKAEPEGL RRLHRAGVQIGIMTFKDYFYCWNTFVENRERTFKAWEGLHEN SVRLTRQLRRILLPLYEVDDLRDAFRMLGF |
| 21 | rAPOBEC-4 | *Rattus norvegicus* | MEPLYEEYLTHSGTIVKPYYWLSVSLNCTNCPYHIRTGEEAR VPYTEFHQTFGFPWSTYPQTKHLTFYELRSSSGNLIQKGLAS NCTGSHTHPESMLFERDGYLDSLIFHDSNIRHIILYSNNSPC DEANHCCISKMYNFLMNYPEVTLSVFFSQLYHTENQFPTSAW NREALRGLASLWPQVTLSAISGGIWQSILETFVSGISEGLTA VRPFTAGRTLTDRYNAYEINCITEVKPYFTDALHSWQKENQD QKVWAASENQPLHNTTPAQWQPDMSQDCRTPAVFMLVPYRDL PPIHVNPSPQKPRTVVRHLNTLQLSASKVKALRKSPSGRPVK KEEARKGSTRSQEANETNKSKWKKQTLFIKSNICHLLEREQK KIGILSSWSV |
| 22 | mfAPOBEC-4 | *Macaca fascicularis* | MEPTYEEYLANHGTIVKPYYWLSFSLDCSNCPYHIRTGEEAR VSLTEFCQIFGFPYGTTYPQTKHLTFYELKTSSGSLVQKGHA SSCTGNYIHPESMLFEMNGYLDSAIYNNDSIRHIILYCNNSP CNEANHCCISKVYNFLITYPGITLSIYFSQLYHTEMDFPASA WNREALRSLASLWPRVVLSPISGGIWHSVLHSFVSGVSGSHV FQPILTGRALTDRYNAYEINAITGVKPFFTDVLLHTKRNPNT KAQMALESYPLNNAFPGQSFQMTSGIPPDLRAPVVFVLLPLR DLPPMHMGQDPNKPRNIIRHLNMPQMSFQETKDLERLPTRRS VETVEITERFASSKQAEEKTKKKKGKK |
| 23 | hAID | *Homo sapiens* | MDSLLMNRRKFLYQFKNVRWAKGRRETYLCYVVKRRDSATSF SLDFGYLRNKNGCHVELLFLRYISDWDLDPGRCYRVTWFTSW SPCYDCARHVADFLRGNPNLSLRIFTARLYFCEDRKAEPEGL RRLHRAGVQIAIMTFKDYFYCWNTFVENHERTFKAWEGLHEN SVRLSRQLRRILLPLYEVDDLRDAFRTLGL |
| 24 | clAID | *Canis lupus familiaris* | MDSLLMKQRKFLYHFKNVRWAKGRHETYLCYVVKRRDSATSF SLDFGHLRNKSGCHVELLFLRYISDWDLDPGRCYRVTWFTSW SPCYDCARHVADFLRGYPNLSLRIFAARLYFCEDRKAEPEGL RRLHRAGVQIAIMTFKDYFYCWNTFVENREKTFKAWEGLHEN SVRLSRQLRRILLPLYEVDDLRDAFRTLGL |
| 25 | btAID | *Bos taurus* | MDSLLKKQRQFLYQFKNVRWAKGRHETYLCYVVKRRDSPTSF SLDFGHLRNKAGCHVELLFLRYISDWDLDPGRCYRVTWFTSW SPCYDCARHVADFLRGYPNLSLRIFTARLYFCDKERKAEPEG LRRLHRAGVQIAIMTFKDYFYCWNTFVENHERTFKAWEGLHE NSVRLSRQLRRILLPLYEVDDLRDAFRTLGL |
| 26 | mAID | *Mus musculus* | MDSLLMNRRKFLYQFKNVRWAKGRRETYLCYVVKRRDSATSF SLDFGYLRNKNGCHVELLFLRYISDWDLDPGRCYRVTWFTSW SPCYDCARHVADFLRGNPNLSLRIFTARLYFCEDRKAEPEGL RRLHRAGVQIAIMTFKDYFYCWNTFVENHERTFKAWEGLHEN SVRLSRQLRRILLPLYEVDDLRDAFRTLGL |
| 27 | pmCDA-1 | *Petromyzon marinus* | MAGYECVRVSEKLDFDTFEFQFENLHYATERHRTYVIFDVKP QSAGGRSRRLWGYIINNPNVCHAELILMSMIDRHLESNPGVY AMTWYMSWSPCANCSSKLNPWLKNLLEEQGHTLTMH FSRIYDRDREGDHRGLRGLKHVSNSFRMGVVGRAEVKECLAE YVEASRRTLTWLDTTESMAAKMRRKLFCILVRCAGMRESGIP LHLFTLQTPLLSGRVVWWRV |

TABLE 13-continued

Amino acid sequences of deaminases

| SEQ ID NO: | Gene name | Species | Sequences |
|---|---|---|---|
| 28 | pmCDA-2 | *Petromyzon marinus* | MELREVVDCALASCVRHEPLSRVAFLRCFAAPSQKPRGTVIL FYVEGAGRGVTGGHAVNYNKQGTSIHAEVLLLSAVRAALLRR RRCEDGEEATRGCTLHCYSTYSPCRDCVEYIQEFGASTGVRV VIHCCRLYELDVNRRRSEAEGVLRSLSRLGRDFRLMGPRDAI ALLLGGRLANTADGESGASGNAWVTETNVVEPLVDMTGFGDE DLHAQVQRNKQIREAYANYASAVSLMLGELHVDPDKFPFLAE FLAQTSVEPSGTPRETRGRPRGASSRGPEIGRQRPADFERAL GAYGLFLHPRIVSREADREEIKRDLIVVMRKHNYQGP |
| 29 | pmCDA-5 | Petromyzon marinus | MAGDENVRVSEKLDFDTFEFQFENLHYATERHRTYVIFDVKP QSAGGRSRRLWGYIINNPNVCHAELILMSMIDRHLESNPGVY AMTWYMSWSPCANCSSKLNPWLKNLLEEQGHTLMMHFSRIYD RDREGDHRGLRGLKHVSNSFRMGVVGRAEVKECLAEYVEASR RTLTWLDTTESMAAKMRRKLFCILVRCAGMRESGMPLHLFT |
| 30 | yCD | *saccharomyces cerevisiae* | MVTGGMASKWDQKGMDIAYEEAALGYKEGGVPIGGCLINNKD GSVLGRGHNMRFQKGSATLHGEISTLENCGRLEGKVYKDTTL YTTLSPCDMCTGAIIMYGIPRCVVGENVNFKSKGEKYLQTRG HEVVVVDDERCKKIMKQFIDERPQDWFEDIGE |
| 31 | pYY-BEM3.1 | tr\|F7B644\| F7B644_HORSE | MPRGRARERQRRNPMEKLDAEAFSFHFLNMEFVYDRNCSYLC YQVEGRLSGSPVLSEQGVFPNEVCGKTRRHAELCFLDWFRGR LSPDEYYCVTWFISWSPCSNCAREVAEFLKRHRNVELSIFAA RLYYCRDHEQGLQSLCNRGAQLAVMLRKDFTYCWDNFVHNSG REFSPWENIDANSDLLARKLEDLLKNPMEKLHRKTFSFHFRN LKFAKGRKCSYLCYRVEGRLSGSPGLSEQGVFLNEVCDENCR HAELCFLHWFRGRLSPHADYRVTWFISWSPCSNCAREVAEFL KQHRNVELHISAARLYYWQRNKPGLRNLRSSGAQLAIMFFWD FRDCWDNFVHNSGRHFIPWKKINVNSRLLATKLEDLLKNPLE KLHPNTFSFHFCNLEFAYDRKYSYLCYQVEGRLSGSPGLSEQ GVFLNEVCGKTRCHAELCFLDWFRVRLSPDEYYRVTWFISWS PCFYCAREVADFLKQYRNVKLSIFAARLYYCRDHAQGLRSLC SSGAQLAIMFFWDFRYCWDNFVHNSGREFRPWKKINVNSRLL ATKLEDILK |
| 32 | pYY-BEM3.2 | tr\|D1LZA1\| D1LZA1_PANTI | MEPWRPSPRNPMDRIDPKTFRFQFPNLRYASGRKLCYLCFQV ERDYFYYNDSDWGVFRNEVHPWAPCHAEQCFLSWFRDQYPYR DEDYNVTWFLSWSPCPTCAEEVVEFLEEYRNLTLSIFTSRLY YFWHPNYQEGLCKLWDAGVQLDIMSCDEFEYCWDNFVYHKGM RFQRRNLLKDYDFLAAKLQEILSPGQQRKRDWPFPPRPGAQV DPRSWVQEVTEPGINTRRHPLHLLVSFLLPRPTMNPLQEDIF YRQFGNQHRVPKPYYYRRKTYLCYQLKLPEGTLIDKDCLRNK KKRHAEICFIDKIKSLTRDTSQRFEIICYITWSPCPFCAEEL VAFVKDNPHLSLRIFASRLYVHWRWKYQQGLRHLHASGIPVA VMSLPEFEDCWRNFVDHQDRLFQPWRNLDQYSESIKRRLGKI LTPLNDLRNDFRNLKLE |
| 33 | pYY-BEM3.3 | tr\|A0A3Q0DM17\| A0A3Q0DM17_TARSY | MPMKRMYSNIYFDHFNNQRLLSGQNAPWLCFKVERVENCMLV PLETGVFGNQVSGCCGKTERPVEPTSLTRSVLVSPNPGTELR AQQPSRKGHLGKLGCVEYPSPGLALVMLGYGASTYCPDSSMY CPETCHHPEMCFLYWFEKTLSHEEQYQITWYVSWSPCVNCAE EVAEFLSVHPKVNLTIYAARLYCYQKLNHRQGLRRLCKEGAC VKIMNYEEFDHCWENFVYNNYKSFKPWVKLQDNYELLATELD KILRIPMERMPQKKFRFHFQNLIAKDRNTTWLCFEVKNVRKK HPPDLLERGIFQNQVTPRINCHAEMCFLSWFLENMLLHGKRY QVTWYISWSPCSICAEEVAEFLSAHPKVSLTIYAARLYYFWV PGYRQGLRRLVEEGARVEIMNYEEFDYCWENFVSINNEPFQP WEGLHEKYGYLVTKLNNILG |
| 34 | pYY-BEM3.4 | tr\|A0A3Q0DNJ5\| A0A3Q0DNJ5_TARSY | MEDNPEPRPRQQMDQDTFIFNFNNDPSVRGRHQTFLCYEVEH LDDDTWVPQDKYLGFLHNQPQSRSNAYCAYHAELCFLELVSS WQLDPAQRYRVTCFISWSPCSSCAQEVAAFLKKNRHVTLRIL AARIYDYYQGYEDGLRTLQGVGVDITVMTSAEFGHCWNTFVD HQGSPFQPWEGLDQHSQVIWQRMQDILQVIPAKYLMEKVKYT VTVDILFKGRVPGPRYLMDQNTFTRNFINNLSVSGRRQTLLC YEVERLGGDIWVPLDQLRGFLLSQARDVLNYYQGRHAEPCFL DLVSSWQLDPAQHYRVTWFISWSPCTSCAQAVAAFLRENRHV TLRILAARIYDYHQGYEEGLRTLQRTGAHIDIMTFKEFGHCW NTFVNHKGSPFKSWTGLDQHSQALRKRLQDILHTMASSLWDQ SEPKKPIPSQEVTLPESIPPSHGNRFRLVKRPS |
| 35 | pYY-BEM3.5 | tr\|G5AYU5\| G5AYU5_HETGA | FCFLSCVHRKPIERIYKKAFRFYFRNLRCAYGRNKTFLCYEV KRERDNKVLHKGVVLNQVEPYMPLHAELRFLSWFHDTLLCPL GSYQVTLYVSWSPCSECAEELTTFLAGHRNVTMTIYVAQLYY CNWKSPNREGLKILIAEDARLRVMFYDEFLYCWRNFVKNDYN |

TABLE 13-continued

Amino acid sequences of deaminases

| SEQ ID NO: | Gene name | Species | Sequences |
|---|---|---|---|
| | | | NFDPWSLLDENSRYHNRILQNILKGWGRPHRVGPEGEQTATPGGSGGHCISVFSLLRRREMTLKEETFRVQFNNAYKAPKPYRRRVTYLCYQLQEANGDPLTKGCLRTKKGYHAESRFIKRICSMDLGQDQSYQVTCFLTWSPCPHCAQELVSFKRAHPHLRLQIFTARLFFHWKRSYQEGLQRLCRAQVPVAVMGHPEFAYCWDNFVDHQPGPFEPPWAKLEYYSSCLKRRLQQILRSWGVDDLTNDFRNLQLGP |
| 36 | pYY-BEM3.6 | tr\|A0A2Y9QMV5\|A0A2Y9QMV5_TRIMA | MLSSPQTPGTRKPMKTLAPDEFSFNFENLRLAHGRNTTFLCFQVETKAPPSLNSPDSGIFQNQDHCPSHHHAEMVFLTWFQKRLSPAQHYEVTWYMSWSPCSRCAVQVAKFLKSNSTVNLSIFVARLYYPRELETKDGLHSLWQAGAQVQIMFFQDFKYCWENFVNNEGKPFQPWKNLDENSKDWDTELKDIHRNTTDLLTEEMFYSQFYNREKKSSIPRKTYLCYQLNEPQPVKRCLHYKKGYHAVTRFIDGIVSMNLDPARSYDITCYFTWSPCNRYARKLVSFIEDYPNLRLKVYTSRLYFHWCWTNMQGLQHLQNSRVTVAVMTFRDFEYCWKNFVDNQGKPFEPWEKLDLYSQSTERRLRRILKPLTPDVLNEDFGNLHL |
| 37 | pYY-BEM3.7 | tr\|H0XHI0\|H0XHI0_OTOGA | LSCAFRDPMNRMYPKTFCQNFEKEPCPSNQNSSWLCFEVETKNSAVFFHRGVFRNQPAPPPRAPTSVLLSQGPVKTPCHAEECFLTWIQGVLPPDHHYHVTWYVSRGPCANCANLIVHFLAMHRRVTLTIFAAHLNFFWESDFQQGLLRMDQEGVQLHIMGYEEFEYCWDNFVYNQRKQFVPWNGLNENYEFMVSTLEDILRSPLDRIRQKDFSIHFRNSLWLDDKSTWLCFEVKRTKSPVPLYRGVFRNQSPPKTPCHAEVRFFTWLQDLPPDFCCQFTWYLSWSPCADCADLVANFLAKHRNVSLTIFVARLYYYRDPEMHRGLRRMYQEGANVDIMSVIEFEYCWDNFVYNQGKQFVPWNGLNENYEFLVPRLQEILE |
| 38 | pYY-BEM3.8 | tr\|A0A3M0K4Y7\|A0A3M0K4Y7_HIRRU | MYISKKALRRHFDPRVYPRETYLLCELQWEGSRRVWIHWIRNVPDHHAEEYFLEEVFEPRNYGFCNITLYLSWSPCCTCCSKIRDFLKRNPNVKIDIRVARLIYPDYAETRSSLRELNGLQRVSIQVMEAAGLSCIESKNHRISQVERDPKGSSSPTLFTLQDHLKLSNMTESVIQDSVSIQICYQMRILGFQCHIRWKLQPEDFQRNYSPNQIGRVVYLLYEVRWRRGSIWRNWCSNNPEQHAEVNFLENHFHHRPQTPCSITWFLSTSPCGKCSRRILEFLKSQPNVTLEIYAAKLFRHHDIRNRQGLRNLMMNGVTIYIMNLEGNPASLCLSVD |
| 39 | pYY-BEM3.9 | tr\|A0A3P4LUZ8\|A0A3P4LUZ8_GULGU | MSFEDYEYCWETFVDHKGMYFQSWDLLRDNDLLAAELKNILRSTMNPLRQEIFYHQFGNQPRAPRPYHRRKTYLCYQLQPHEGPITARVCLQNKKKRHAEIRFIDNIRALRLDRSQTFEITCYLTWSPCPTCAKALAVFVQDHPHISLRLFASRLFIHWCWKYQEGLRLLHRSRIPVAVMRLQEFEDCWRNFVDNQDEPFQPWNKLEQYSESITRRLRRILGHPQNNLENDFRNLHI |
| 40 | pYY-BEM3.10 | tr\|G5BPM8\|G5BPM8_HETGA | RRRIEPWQFEASFDPRQLRRETCLLSEVRWGTSPRAWRGCSLNTARHAEVSFMDRLTSEGRLRGPVRCSITWFLSWSPCGACAQAIGEFLRQHPNVSLVIYIARLFWHVDEQNRQGLRDLVTRGVRMQVMSDPEFAHCWRNFVNYSPGQEARWPQVPPVWTWLYSLELHCILLNLPPCLKISRRHHNQLTFFQLILQNCHYQAIPSPVLLASGLIHPFVTW |
| 41 | pYY-BEM3.11 | tr\|H2M862\|H2M862_ORYLA | MITKLDSVLLPKKKFIYHYKNMRWARGRHETYLCFVVKRRVGPESLSFDFGHLRNRNGCHVELLFLRHLSALCPGLWGYGATGQGRVSYSITWFCSWSPCANCSFRLAQFLSQTPNLRLRIFVSRLYFCDLEDSREREGLRMLKKVGVHITVMSYKDYFYCWQTFVARKQSKFKPWDGLHQNSVRLSRKLNRILQPCETEDFRDAFKLLGL |
| 42 | pYY-BEM3.12 | tr\|H0Y0C6\|H0Y0C6_OTOGA | MYLKTFYRHFNNRPYLSRRNDTWLCFEVKTTSSNSPGSFYSGVFRNQGPRYCPWHTELCFLTWVRPIVSHHHFYQITWYMSWSPCANCAWQVATFLATHENVSLTNYTVRIYYFWRQDYRQGLLRMIEEGTQVYVMSSKEFQHCWENFVDHWGTRWVTCWNRLKKNYEFLVTRLSEILSDPKERISPNTFYNQFNNTPVPRGRKDTWLCFEVKEKNSNSPGSFHRGVFQNQVFSGTSSHARRCPPDHHYEVTWYTSWSPCAHCAWHVVNFLTSNPNVSLTIFAARLYYIYRPEIQQGLRRVFQEGAKVHIMSLKEFKYCWAKLVYNSGMRFMPWYQFNFNFLFPNTTLKGDLH |

TABLE 13-continued

| Amino acid sequences of deaminases | | | |
|---|---|---|---|
| SEQ ID NO: | Gene name | Species | Sequences |
| 43 | pYY-BEM3.13 | tr\|A0A3Q2Z5X6\|A0A3Q2Z5X6_HIPCM | MDVHFMNFIYHYKNMRWAKGRNETYLCFVVKRRVGPNSLTFDFGHLRNRNGCHVELLFLRYLGRRLSYSITWFCSWSPCANCSAALSQFLSRMPNLRLRIFVARLYFCDMEDSHEREGLRLLQKAGVQVTVMSYKDYYYCWQTFVDRKKSHFKAWEDLHQNSVRLSRKLNRILQPCEMDLRDAFKLLGL |
| 44 | pYY-BEM3.14 | tr\|A0A2K6NVA7\|A0A2K6NVA7_RHIRO | MKPQIRDHRPNPMEAMYPHIFYFHFENLEKAYGRNETWLCFTVEIIKQYLPVPWKKGVFRNQVDPETHCHAEKCFLSWFCNNTLSPKKNYQVTWYTSWSPCPECAGEVAEFLAEHSNVKLTIYTARLYYFWDTDYQEGLRSLSEEGASVEIMDYEDFQYCWENFVYDDGEPFKRWKGLKYNFQSLTRRLREILQ |
| 45 | pYY-BEM3.15 | tr\|A0A2K6NY90\|A0A2K6NY90_RHIRO | MNPHIRNPMEAMYPGTFYFHFKNLWEADNRNESWLCFAVEVIKHHSTVSWKRGVFRNQVDPETHCHAEKCFLSWFCDNTLSPKKNYQVTWYTSWSPCPECAREVAKFLARHSNVMLTIYTARLYYSQYPNYQEGLRRLNEEGVPVEIMDYEDFKYCWENFVYNGDELFKPWKGLKYNFLFLDSKLQEILE |
| 46 | pYY-BEM3.16 | tr\|Q6ICH2\|Q6ICH2_HUMAN | MNPQIRNPMERMYRDTFYDNFENEPILYGRSYTWLCYEVKIKRGRSNLLWDTGVFRGPVLPKRQSNHRQEVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ |
| 47 | PYY-BEM3.17 | tr\|G8GPV1\|G8GPV1_CERNE | MDGSPASRPGHVMDPGTFTSNFNNKPWVSGQRETYLCYKVERSHNDTWVLLNQHRGFLRNQAKNRLHGDYGCHAELCFLGEVPSWRLDPTQTYRVTWFISWSPCFSGGCAEQVRAFLQENTHVRLRIFAARIYDYDFLYQEALRTLRDAGAQVSIMTYEEFKHCWDTFVDHQGRPFQPWDGLDEHSQALSGRLQAILQNQGN |
| 48 | pYY-BEM3.18 | tr\|Q1WBT6\|Q1WBT6_SYMSY | MALLTAKTFRLQFNNKRRVTKPYYPRKALLCYQLTPQNGSTPTRGYFKNKKKRHAEIRFINKIKSMGLDETQCYQVTCYLTWSPCPSCAWELVDFIKAHDHLNLGIFASRLYYHWCRHQQEGLRLLCGSQVPVEVMGFPEFADCWENFVDHEEPLSFNPSEMLEELDKNSRAIKRRLEKIK |
| 49 | pYY-BEM3.19 | tr\|A0A3B4CS14\|A0A3B4CS14_PYGNA | MDNTNRRKFIYHYKNVRWARGRHETYLCFVVKKRNSPDSLSFDFGHLRNRNGCHVELLFLRYIEVLCPGLWGSGVDGVRVSYAVTWFCSWSPCSNCAQRLTNFLSQTPNLRLRIFVARLYFCDEEDSLEREGLRHLQRAGVQITVMTYKDFFYCWQTFVASRERCFKAWEGLRQNSVRLSRKLNRILQVFISTPVISPLITTHLGQSWAGG |
| 50 | pYY-BEM3.20 | tr\|A0A087XZI4\|A0A087XZI4_POEFO | RKVSYSVTWFCSWSPCANCSIRLAQFLHQTPNLRLRIFVSRLYFCDLEDSREREGLRILKKAGVHITVMSYKDYFYCWQTFVAKSQSKFKPWDGLHQNYIRLSRKLNRILQPALDIKKFIYHYKNLRWARGRCETYLCFVVKKKLHLFMFVIVGRNRLFDLNVTMNNKSLYLIPLHLQLLFLRHLGALCPGLWGYGVTGERKVSYSVTWFCSWSPCANCSIRLAQFLHQTPNLRLRIFVSRLYFCDLEDSREREGLRILKKAGVHITVMSYKDYFYCWQTFVAKSQSKFKPWDGLHQNYIRLSRKLNRILQVQFF |
| 51 | pYY-BEM3.21 | tr\|A0A341AEK4\|A0A341AEK4_9CETA | MASDRGPSAGDATSRRRIEPWEFEVSFDPRELCKETRLLYEIKWGRSQHVWRHSGKNTTNHVECNFIEKFTSERPFHRSVSCCITWFLSWSPCWECSKAIREFLNQHPRVTLFIYVARLFQHMDPQNRQGLRDLIHSGVTIQIMGPTEYDYCWRNFVNYPPGKEAHWPRYPPPLMKLYALELHCIILVP |
| 52 | pYY-BEM3.22 | tr\|E2D879\|E2D879_MUSMI | RNLISRETFNFNFENLCYAKGRKNTFLCYEVTRKDCDSPVSLCHGVFKNKGSIHAEICFLYWFHDKVLKVLTPREEFKVTWYMSWSPCFECAEQVVRFLATHHNLNLTIFSSRLYNVSDPDTQQKLCRLVQEGAQVAVMDLSEFKKCWEKFVDNDGQQFRPWKRLRTNFRYQNSKLQEIL |
| 53 | pYY-BEM3.23 | tr\|A0A2K5RDN6\|A0A2K5RDN6_CEBCA | MWEAQSPGLSREWGSVAISPEDPGPLHIGRFLSCAFRHPMNAMYPGIFNFHFRNLRKAYGRNETWLCFTVEGIMNRSTVSWKSGVFRNQVGSDPFCHAEMCFLSWFRHNMLSPKKDYEVTWYASWSPCPECAGQVAEFLARHGNVRLTIFTAHLYYFWNPSFRQGLRRLSQEGASVLIMGYEDFEYCWDNFVYNDGQPFKPWKRLQDNSLSLYITLQEILQ |

TABLE 13-continued

| SEQ ID NO: | Gene name | Species | Sequences |
|---|---|---|---|
| | | Amino acid sequences of deaminases | |
| 54 | pYY-BEM3.24 | tr\|A0A2K5RDN7\|A0A2K5RDN7_CEBCA | MEASPASRPRPLMGPRTFTENFTNNPEVFGRHQTYLCYEVKCQGPDGTRDLMTEQRDFLCNQARNLLSGFDGRHAERCFLDRVPSWRLDPAQTYRVTCFISWSPCFSCAREVAEFLQENPHVNLRIFAARIYDCRPRYEEGLQMLQNAGAQVSIMTSEEFRHCWDTFVDHQGHPFQPWEGLDEHSQALSRRLQAILQGNRWMILSL |
| 55 | pYY-BEM3.25 | tr\|A0A1C9CJ69\|A0A1C9CJ69_CERAL | NPMKAMDPHIFYFHFKNLRKAYGRNETWLCFAVEIIKQRSTVPWRTGVFRNQVDPESHCHAERCFLSWFCEDILSPNTDYRVTWYTSWSPCLDCAGEVAEFLARHSNVELAIFAARLYYFWDTHYQQGLRSLSEKGASVEIMGYEDFKYCRENFVCDDGKPFKPWKGLKTNFRFLKRRLQEILE |
| 56 | pYY-BEM3.26 | tr\|A0A2R2Z4D2\|A0A2R2Z4D2_PTEAL | MHLQVWRKVTEAWREGYTLKPWSRNPMERLYHDYFYFHFYNLPTPKHRNGCYICYQVEGTKKHSRMPLLRGVFENQESLDMMLSPGEKYRVTWYISWSPCFACVDEVIKFLREHINVELIIFAARLYHSDILQYRQGLRKLHDAGVHVAIMSYYEFKHCLNDFVFHQGRSFCPWNDLNKNSKNLSNTLEDILRNQED |
| 57 | pYY-BEM3.27 | tr\|B7T161\|B7T161_SHEEP | MTEGWAGSGLPGRGDCVWTPQTRNTMNLLRETLFKQQFGNQPRVPPPYYRRKTYLCYQLKELDDLMLDKGCFRNKKQRHAEIRFIDKINSLNLNPSQSYKIICYITWSPCPNCASELVDFITRNDHLNLQIFASRLYFHWIKPFCRGLHQLQKAGISVAVMTHTEFEDCWEQFVDNQLRPFQPWDKLEQYSASIRRRLQRILTAPT |
| 58 | pYY-BEM3.28 | tr\|A0A2R2X2G4\|A0A2R2X2G4_PTEAL | MAGLGQACEGCCGQMPEISYPMGRLDPKTFSFEFKNLPYAYGRKSSYLCFQVEREQHSSPVPSDWGVFKNQFCGTEPYHAELCFLNWFRAEKLSPYEHYDVTWFLSWSPCSTCAEEIAIFLSNHKNVRLNIFVSRIYYFWKPAFRQGLQELDHLGVQLDAMSFDEFKYCWENFVDNQGMPFRCWKKVHQNYKSVLRKLNEILRRR |
| 59 | pYY-BEM3.29 | tr\|G1Q1M4\|G1Q1M4_MYOLU | YAELSFLDLFQSWNLDRGRQYRLTWYMSWSPYPDCAQKLVEFLGENSHVTLRIFAADIHSLCSGYEDGLRKLRDARAQLAIMTRDELQYCWVTFVDNQGQPFRPWPNLVEHIKTKKQELKDILGNPMRRMYPKTFNFNFQNLNSYGRKSTFLCFEVETWEDGSVLDYQNGVFQNQLDPGHAELCFIEWFHEKVLFPDEVRCPDAQYHVTWYISWSPCFECAEQVAGFLNEHENVDLSISAARLYLCEDEDEQGLQDLVAAGAKVAMMAPEDFEYCWDNFVYNRGWPFTYWKHVRRNYGRLQEKLDEILW |
| 60 | pYY-BEM3.30 | tr\|A0A1S3AN78\|A0A1S3AN78_ERIEU | RRIEPWEFEDFFDPRQFRPETCLLYEVRWGSSRNAWRSTARNTTRHAEVNFLERFAAERHFDKPVSCSITWFLSWSPCWECSQAIGAFLSQHPQVTLAIHVTRLFHHEDEQNRQGLRDLLARGVTLQVMGDSEYAHCWRTFVNSPPGAEGHYPRYPSDFTRLYALELHCIILGLPPCLEILRRYQNQFTLFRLVPQNCHYQMIPHLNFFVVRHYFF |
| 61 | pYY-BEM3.31 | tr\|A0A151P7C9\|A0A151P7C9_ALLMI | MADSSEKMRGQYISRDTFEKNYKPIDGTKEAHLLCEIKWGKYGKPWLHWCQNQRMNIHAEDYFMNNIFKAKKHPVHCYVTWYLSWSPCADCASKIVKFLEERPYLKLTIYVAQLYYHTEEENRKGLRLLRSKKVIIRVMDISDYNYCWKVFVSNQNGNEDYWPLQFDPWVKENYSRLLDIFWESKCRSPNPW |
| 62 | pYY-BEM3.32 | tr\|Q4VUI3\|Q4VUI3_XENLA | MTMDSMLLKRNKFIYHYKNLRWARGRHETYLCYIVKRRYSSVSCALDFGYLRNRNGCHAEMLFLRYLSIWVGHDPHRNYRVTWFSSWSPCYDCAKRTLEFLKGHPNFSLRIFSARLYFCEERNAEPEGLRKLQKAGVRLSVMSYKDYFYCWNTFVETRESGFEAWDGLHENSVRLARKLRRILQPPYDMEDLREVFVLLGL |
| 63 | pYY-BEM3.33 | tr\|E2RL86\|E2RL86_CANLF | MNPLQEETFYQQFSNQRVPKPTYQRRTYLCYQLKPHEGSVIAKVCLQNQEKRHAEICFIDDIKSRQLDPSQKFEITCYVTWSPCPTCAKKLIAFVNDHPHISLRLFASRLYFHWRQKYKRELRHLQKSGIPLAVMSYLEFKDCWEKFVDHKGRPFQPWNKLKQYSESIGRRLQRILQPLNNLENDFRNLRL |
| 64 | pYY-BEM3.34 | tr\|G1LWB0\|G1LWB0_AILME | SSAAPASIHLLDEDTFTENFRNDDWPSRTYLCYKVEGPDQGSGVPLGQDKGILHNKPAQGPEPSRHAECYLLEQIQSWNLDPKLHYGVTCFLSWSPCAKCAQKMARFLQENSHVSLKLFASRLYTRERWDEDYKEGLRTLKRAGASIAIMTYREFEHCWKTFVLHDQEGSCFQPWPFLHKESQKFSEKLQAILQVGVLLLSLPPPLPSSPLSSPWPFPAPLRASTG |
| 65 | pYY-BEM3.35 | tr\|A0A1U7S7K7\|A0A1U7S7K7_ALLSI | MGEHWQYAGSGEYIPQDQFEENFDPSVLLAETHLLSELTWGGRPYKHWYENTEHCHAEIHFLENFSSKNRSCTITWYLSWSPCAECSARIADFMQENTNVKLNIHVARLYLHDDEHTRQGLRYLMKMKRVTIQVMTIPDYTYCWNTFLEDDGEDESDDYGGYAGVHED |

TABLE 13-continued

Amino acid sequences of deaminases

| SEQ ID NO: | Gene name | Species | Sequences |
|---|---|---|---|
| | | | EDESDDDDYLPTHFAPWIMLYSLELSCILQGFAPCLKIIQGN HMSPTFQLHVQDQEQKRLLEPANPWGAD |
| 66 | pYY-BEM3.36 | tr\|A0A2R2X2J8\| A0A2R2X2J8_PTEVA | MPRIGNMNLLSEKTFNYHFGNQLRVKKPQGRRRTYLCYKLKL PNETLVKGYFINKKKNHAEIRFINKIRSLNLDQTQSYKITCY ITWSPCSYCAGKLVALVKSCPHLSLQIFTSRLYYHWLWKNQA GLRYLWKINISVLVMKEPEFADCWDNFVNHQSRRFKPWEKLT QYSNSTERRLLRILRINRTDLFLAQSSEQDPGLNDLVDAIKR LFLDAHRPRD |
| 67 | pYY-BEM3.37 | tr\|A0A151P6M4\| A0A151P6M4_ALLMI | MAVEEEKGLLGTSQGWKIELKDFQENYMPSTWPKVTHLLYEI RWGKGSKVWRNWCSNTLTQHAEVNCLENAFGKLQFNPPVPCH ITWFLSWSPCCQCCRRILQFLRAHSHITLVIKAAQLFKHMDE RNRQGLRDLVQSGVHVQVMDLPDYRYCWRTFVSHPHEGEGDF WPWFFPLWITFYTLELQHILLQQHALSYNL |
| 68 | pYY-BEM3.38 | tr\|A0A2K6MNR2\| A0A2K6MNR2_RHIBE | IWLCFTMEIIKQCSTVSWKRGVFRNQVDPETHCHAERCFLSW FWEDTLSPNTNYQVTWYTSWSPCLDCAGEVAEFLARHSNVKL AIFAARLYYFWDTDYQQGLRSLSEEGTSVEIMGYEDFKYCWE NFVYNGDEPFKPWKGLKYNFLFLDSKLQEILE |
| 69 | pYY-BEM3.39 | tr\|D3U1S2\| D3U1S2_PIG | MDPQRLRQWPGPGPASRGGYGQRPRIRNPEEWFHELSPRTFS FHFRNLRFASGRNRSYICCQVEGKNCFFQGIFQNQVPPDPPC HAELCFLSWFQSWGLSPDEHYYVTWFISWSPCCECAAKVAQF LEENRNVSLSLSAARLYYFWKSESREGLRRLSDLGAQVGIMS FQDFQHCWNNFVHNLGMPFQPWKKLHKNYQRLVTELKQILRE EPATYGSPQAQGKVRIGSTAAGLRHSHSHTRSEAHLRPNHSS RQHRILNPPREARARTCVLVDASWICYR |
| 70 | pYY-BEM3.40 | tr\|F1CGT0\| F1CGT0_ANOCA | KAAILLSNLFFRWQMEPEAFQRNFDPREFPECTLLLYEIHWD NNTSRNWCTNKPGLHAEENFLQIFNEKIDIKQDTPCSITWFL SWSPCYPCSQAIIKFLEAHPNVSLEIKAARLYMHQIDCNKEG LRNLGRNRVSIMNLPDYRHCWTTFVVPRGANEDYWPQDFLPA ITNYSRELDSILQD |
| 71 | pYY-BEM3.41 | tr\|C7AGG3\| C7AGG3_HORSE | MDPQAPTQRGGLGQAYQGGDYVQAPGNGNTQHLLSEDVFKKQ FGNQRRVTKPYYRRKTYVCYQLKLLRGPTIAKGYFRNKKKRH AEIRFIDKINSLGLDQDQSYEITCYVTWSPCATCACKLIKFT RKFPNLSLRIFVSRLYYHWFRQNQQGLRQLWASSIPVVVMGY QEFADCWENFADNRGNPFQSWEKLTEYSKGIKRRLQKILEPL NLNGLEDAMGNLKLGSVDLG |
| 72 | pYY-BEM3.42 | tr\|A0A250YMK7\| A0A250YMK7_CASCN | MSLLKEDIFLYQFNNQQQVQKPYFRRRTYLCYQLEQPNGSRP QWPAKGCLQNKKGHHAEIRFIKRIHSMGLEQDQDYQITCYIT WSPCLACACALAELKNHFPRLTLRIFASRLYFHWIRKFQMGL QHLYKSGVLVAVMSLPEFTDCWEKFVNHRQVFFTPWDKLEEH SRSIQRRLRRILQSWDVDDLTDDFRNLRL |
| 73 | pYY-BEM3.43 | tr\|B7T160\| B7T160_SHEEP | MPWISDHVARLDPETFYFQFHNLLYAYGRNCSYICYRVKTWK HRSPVSFDWGVFHNQVYAGTHCHSERRFLSWFCAKKLRPDEC YHITWFMSWSPCMKCAELVAGFLGMYQNVTLSIFTARLYYFQ KPQYRKGLLRLSDQGACVDIMSYQEFKYCWKKFVYSQRRPFR PWKKLKRNYQLLAAELEDILG |
| 74 | pYY-BEM4.1 | tr\|A0A182D0J1\| A0A182D0J1_BLAVI | MTNPESPPQAPCDFNEDALLNREPLRGSPIKFVSPVDYPDLV FALAGPVGVDIDYIQQSISDCLKSFDYSTEFIRITEIMQDIK CSKTIDCTDMLKEYQSKIEYANELRRAYRAKDLLAALTISAI SKLREQIKERDEATNKSNIQPSRRKLAWVVRQLKTPEEVRLL RAVYGKQFVLVSIYSSPQRREDFLISKIKIKSRGTIDNNTSS EGAQRLIERDSKEDNEYGQNLSGTFCLGDIFVDSNNKESAIV SIDRFLNAFFGSNEISPTRDEYGMYLAKTASLRSCDLSRQVG AAIFSKTGEIISLGSNEVPKAGGGTYWTGDNADSRDIRLGHD PNEINKVEIFAEIISRLLEDKLLSNDLLNKDAASIVTILLSK NEGKRYKDLRVMDIIEFGRIIHAEMSAICDAARNGRAIIGAT LFCTTFPCHLCAKHIVASGIGRIVYLEPYPKSYAKKLHSDSI QVEDHSDSEKVSFEPFIGISPSRYRELFEGGRRKDPFGEALK WKNDPRKPVIDVVVPPHFEAEKLVIAQLGKLIVSGTG |
| 75 | pYY-BEM4.2 | tr\|A0A2D6EXD2\| A0A2D6EXD2_9ARCH | MIIGLVGTIGAGKQTIIDYLQEKYGYNALSCSDVLREILKKQ GKPVTRDNLREIGNKTREEGGNGAIAKILLEKLRNNWKANYI VDSLRHPDEVSVLRTSPLFHLVAVDADLRIRFERVKARKREE EPTTLPAFVERDQKEMFGTGNEQRIRETMELADELVLNNGTV EELKQRIDDLNLVSDERLRPSWDDYFMRLARLAAQRSNCMSR |

TABLE 13-continued

Amino acid sequences of deaminases

| SEQ ID NO: | Gene name | Species | Sequences |
|---|---|---|---|
| | | | KVGAIITKDRRVIATGYNGTPRGVKNCNEGGCERCNSAVAKG TAISECLCLHGEENAIIEAGRVRSEGATIYTSFLPCLWCTKM IIQAGLKEVVFSEVYDLHEASIKLFETSGVLIRRLK |
| 76 | pYY-BEM4.3 | tr\|F7YVM7\| F7YVM7_9THEM | MNEFKYMSLALKLAKKGKYTTSPNPMVGAVIVKDGKILATGY HKKAGQPHAEINALSKLNFQAQNCEMYVTLEPCSHYGRTPPC ADAIIRSGIRKVVIATLDPNPLVNGKGVEKLKNAGIEVVCGV LEEKAKKLNEKFFKYITTKIPFVALKIAQTLDGKIALKNGES KWITSEKSREYVHKLRMEYDAVLTGIGTILKDDPQLNVRLKK VYKQPLRIILDSKLKIPLSAKVLEDPSKVIILTTALADKEKL EELRSKGVEVIITNEKNGIVDLESALKILGEKKITSVMVEAG PTLLTSFLKESLFDKIYLFIAPKIFGADSKSVFSELGLEDIS KSQKFSLESVKKIGEDLLLELYPKQLKKLEE |
| 77 | pYY-BEM4.4 | tr\|A0A3M6UNF1\| A0A3M6UNF1_9CNID | MEEKSELENELMRSTSPKPSVPNGSKGNECEQRETRITKENL YMVLALWMEEFPVVEQTSSAKRLNKVGVVFVLPTDRVLAADC SRDGVHGVARVMVNHCGKLEGCKVFVSRKPCSLCAKLLVQSK VSRVFYLPIEPESENKGEIARADNLFKNSSVGQSVFVPCVEQ KVLDKLEDKLPKEIITPDDISECRDNLLKKCGWSAEWFARAQ ASLPWPCFEGKMKSQVDNDFKSLIKWIAVVKAPMDKGVAFPK VKLTSDSRVVPDCDADNFPDSKTAYHMMIFAKMLARQTDDPK TGVGAVIVRGKVPDIVSLGWNGFPSKALYGEFPRASDDDRAL QKKFPYVIHAEQNALMVRNVKDLTDGILFVTKPPCDECAPMI KLSGVKTIVIGEKIEKSRGGELSYNLIKEYIKEGIMTCYQME ATKTKAKRLASDPETRKRLKSSCSNSNDV |
| 78 | pYY-BEM4.5 | tr\|A0A2G3K826\| A0A2G3K826_9BURK | MTKIIDDVNTAAAAVLDQATAAANQTTFAVGGVMVNNQTGEV ISAIHNNVIIPLSNNVSFTFDPTAHGERQLVYWYYANKEALK LPEPNQITVITSLDPCAMCTGALLTAGFNVGVVAIDTYAGIN CAQNFQFATLPANLRTKAQKNFGYYASGAANFKPLTRSYVGG PSVAFKNGVVTPANLRDCGTVFTQSVDTVRNTSNSTGLAPSQ MSNPAELPSNSAILQAYRAIYKKAFTIKIDNPRLPDAQILTE LKAVLADAPNARNAVAFIDPFGNLVLCMADAFNTSPVHAAFM NVTQEYAKTRWDLMNKYAQASTTDNPALYLTHPKYGTFVYLY APDPDDSITIMSLGAYGSTMEGPIPNMFPSNLQFYYPPRNGA QFSELVPVVNELPPFYTQNVNISLMQVPGVTQAPTK |
| 79 | pYY-BEM4.6 | tr\|K1ZCJ4\| K1ZCJ4_9BACT | MSSRAKKNRSTNLKKSIGQKSIENKPTDQKKDQVLVAYVPVI HEGYRRFFRHFPAVKELWLISQELSHELRSLQKDIRALKASE TKKLLQTWGQFQKIKLLTPSSLAILQKTTTQLVFPDEEISHH LVEKYFAQNRVLFASFFLRWDKKSSLKKHDLQEYSEISNKEF DQMMIAIAQQEADKSDDWWRQVGGLIFKDETILLLAHNQHTP TEAEAYFAGDPRADFHQGEYLKISTAIHAEAYLIAQAAKQGI SLEGADLYVTTFPCPVCAKQVAYSGIKRVFFREGYSLLDGET ILKANGVKLIRVTV |
| 80 | pYY-BEM4.7 | tr\|A0A1G3PNQ8\| A0A1G3PNQ8_9SPIR | MRDLPLLVLGLTGPMGAGCTRFARDISKMEPGKVIKKQGLLD QVAHEISELSKKASEIRLQCISNGKNSELAELKRLNRRLNAK LAERACLHVIAKSSLPEPLFISLNTIVIKIAVDSITAPEFAE WAKNHAKVADLLKWLRTQWESELTLYETWGQDAGRFSQDELE KMDAMFAEFERIGDEILKEDFETYFGKRNNDFSIRMFSENIR LSGNPFRPAENGGGGGKYDEPSMVMIARETDRYIRFYRTRSD QKRSHFFIIDEIKNPREAEYFRARHQNFFLVSIFSSSEIRAS RMRRGLGHDAGVSDADFQHLFRELDSRDWGADDFDAHGLHRQ NIYRCFNLADIAINNDVEDERFSEVLFNKFIRYYALMLSPGC VQPTPQETYMHLAYSLSLRSTCISRQVGAVITDLEDRILSLG WNEVPEGQIGCGLKVKKDYTDKENPLFEMEIWDNVITAEDLA VWDDEDSICVKDILSRIEIKTKLKSVSLTPEERADVLKALRI KRLEYSRSLHAEENAILQVASRGGVGLKDGTIYVTTFPCELC SKKIYQVGISKIYYTEPYPNSISEKVILKDGIRNIKILQFEG VKSYSYFKLFKPGFDKKDAQMLEGRGI |
| 81 | pYY-BEM4.8 | tr\|A0A1G0PGF4\| A0A1G0PGF4_9BACT | MKHNNQLRKEIEKLLGQNSIIKNDELKKLQKEYKIETDELLI SFLPYAAEFAKVPISKYKVGAVVLGKSGNIYFGSNMEFEAGA LSATVHAEQSAVNNAWLNGETGINKIAVTAAPCGYCRQFLNE LTTAKQLHVLLKDKNLEAAKVFKLTELLPEAFGPRDLEIEGG LMKVENHKLKIENINDELINAALEAANKSYAPYSKNYSGVSI QLSDGTIFSGRYSENAAYNPSLLPFQSALAFMNMNTKKGSNN KIVDAVLVEAVSNISQKDAAGTLLNSISKTKLRYYKIKN |
| 82 | pYY-BEM4.9 | tr\|A0A0P4WGY5\| A0A0P4WGY5_9EUCA | MEENSSATSQPKCASRTKQGGNDLSTDMSNLSVGETKRTDFL PWDDYFMAVAFLSAMRSKDPSSQVGACIVNADKKIVGIGYNG MPIGCSDDELPWNKESLDPLQTKYMYVCHAEMNAIMNKNSSD LAGCCVYVALFPCNECAKLVIQAGIREVVFFSDKHQQKPETV ASKKMLNMAGVAYRQYTPSQSKIELNLSLKEQEKSEPTADIT |

TABLE 13-continued

Amino acid sequences of deaminases

| SEQ ID NO: | Gene name | Species | Sequences |
|---|---|---|---|
| | | | QSSERDQNSKRKDYLSWEEYFMAMAHLSALRSKDPITQVGAC<br>IVNSKKKIVGIGYNGMPLGCNDDLMPWGNSSSNKLETKYMYV<br>CHAGVNAIMNKNSCDVSGCTLYVALFPCNECAKVIIQAGIKT<br>IIYASDTNKDQASILASKKMLDMAGIKYRADNLSQRKIVIDF<br>KTIDWNSRFMNDHQNDPTCL |
| 83 | pYY-<br>BEM4.10 | tr\|A0A3D8IG27\|<br>A0A3D8IG27_9HELI | MRKNILYFILTLFFLSGLYATSLPEDNVVSGVIYEKIDTVSA<br>EVDHIYPMLALAIVYKDWQEKNMLNKQGHNIGLVIVDENNMP<br>VFWVRNSVHATHNGTQHGEVRLVSNLLNCEGFNKYLDKYTLY<br>TTLEPCIMCAGMLSMVQIPKVVYAQKDLSCGNTQEIISTAKY<br>PRYYKAFTVENGYKKDLEECFEQYKICKNDSITDFLVNDSAK<br>EIFRKASNDLQDYKVKFKENRRVIKVAQEFLQNIQTKDNLDV<br>LQCPKNM |
| 84 | pYY-<br>BEM4.11 | tr\|A0A351C8C4\|<br>A0A351C8C4_9BACT | MNELTKQSEHLRNEALRIATRSYVPYTGQQEGVIILLENGDL<br>IPGVRVENASFQLTIPALQNALSTMYALQRTDISMIVSSIPF<br>TDSDLAYTGGMAEIAWEMVGASLLLVAGAHIPEAGTFIDPAR<br>GENLLDVSREAALNAFIPESDFPVGSAIQTSDDVVIDGCNVE<br>HSDWSKIICAERNVLSTARSYGLGQITTIYVSCPKEPGGTPC<br>GACRQVIVELAPDATVWMDRGNQEPIAMKATKLLPGHFTGNV<br>LKKQ |
| 85 | pYY-<br>BEM4.12 | tr\|A0A1G6V2K7\|<br>A0A1G6V2K7_PEPNI | MPIVRVNEIGARLPEDWEALETAIWQAYVSREDLPDAGELDL<br>TLVDDATIQELNKTHRQLDKSTDVLSFPMYDDRDDLAADVQA<br>GLPVILGDIMISVPTAERQAQAYGHSFKREMAYLLVHGLLHI<br>AGYDHMSAEEKSAMRRAEEAILADVDVPRDTAPSKTAAVLDE<br>ADVQALIDAARAARLQAYAPYSGYAVGAALLAADGRRFCGVN<br>VENASYGATCCAERTALFAAVTAGARDFIALALVTEGDEPAP<br>PCGLCRQALAEFSPDLAIYLAGPTGETYRRTSLAALFPEAFS<br>LSTKESV |
| 86 | pYY-<br>BEM4.13 | tr\|F2NP91\|<br>F2NP91_MARHT | MPVMETHALEARFKEALARLCPEGRLLAAVSGGGDSVALLYL<br>LKAAGRDTIVAHLDHALRPDSAADAAFVEKLAQRLGFPLETE<br>HVDVRALAHRKRINLEAAAREVRYAFLARVARRWKARCILTA<br>HTLDDNAETVLLQILRGAGRGLGIRPLQRRVARPLLEFSRAE<br>LRAYLEARGARWLEDPTNRSLELDRNYLRHAVLPRITARFPH<br>ALEALARFSQAQQADDWALEALSARHLIPDRRWPVPAYRALP<br>LERAPEALRRRAIRGVLEALGVRPEARLVADVEAALGGRAQT<br>LPGGVVVRRQRGTLFFIPPTVRFPKVQPPAGLEARPPRPGDY<br>LVFPYGRKRLVDFLNERGVPRELKRRWPVGAVGAEVRWVYGL<br>WPEPDEDRYMRRALVLARAAARQGEVPIGAVLVRDGAVLAEA<br>ANAVEASRDATAHAELLALRTALRRVGEKVLPGATLYVTLEP<br>CPMCYGAILEARVARVVYGVENLKAGAFTVHGLEPRVALEAG<br>RVEGECAKVLKDFFARLRPGRDGA |
| 87 | pYY-<br>BEM4.14 | tr\|A0A316TX77\|<br>A0A316TX77_9BACT | MINGYTPYSGNQNTCYVKGESGTFYPGVRIENVSYPLTISSV<br>QAAVCSCLANSDNPVEYYTGDHQPELLQVWADEYDMKPGGKL<br>PDSPLKLFDPLVPSIPDIKKELDVLTEKSVTPNSGFPVSALL<br>QTEKGYIRGVNIELSSWALGLCAERVAISRALTAGYTQFKSI<br>HIYAPEADFVSPCGACRQVLLEVMPDADTELYHGDGTLSKHI<br>VSDLLPFGFTSHKLKK |
| 88 | pYY-<br>BEM4.15 | tr\|R6VYG3\|<br>R6VYG3_9FIRM | MIHKGTQTIETKRLILRAFTPDDAEAAFENWMSDPKVTEFLR<br>WKTHADISDSRKIVNEWANGSADPEFYQWAIVPKDVNEPIGT<br>ISVVDRNDALGIFHIGYCIGSKWWHKGITSEAFSAVIHFLFE<br>EVGANRIESQHDPENIHSGDVMKKCGLTFEGTLRQADFNNRG<br>IVDACVYSILQSEWQNNTSVWQRLYNAALTVQNDRVVSPFID<br>AGGVAAALMTKKGNIYTGICIDTASTLGMCAERNAVANMLTN<br>GESRIDKIVAVMPDGKVGAPCGACREYMMQLDRDSGDIEILL<br>DLETEKTVRLKDLIPDWWGAERFGDTE |
| 89 | pYY-<br>BEM4.16 | tr\|A0A3C1HZ18\|<br>A0A3C1HZ18_9BACI | MGDIMENWNELSEPWKRCFLQAWKAYCHGSIPIGAVLVDSEG<br>EIFLEGRNRVHELTAPEGQLCDCRIAHAEMNVLVQVKTSDYE<br>KLSGATIYSTMEPCIQCFGAIILSRIKNISFAAIDDKLAGAT<br>TLEDRHGFIKSRNLNIAGPFSHLGEIQIILRTDFLLRIFDSE<br>YADPLIAAHEKDYPIGVALGRHYHRNNRLQVAKKETIPFGEL<br>FNEFSFDIKRAREGYTLGK |
| 90 | pYY-<br>BEM4.17 | tr\|A0A1M6KV24\|<br>A0A1M6KV24_9BACT | MEASQQNILLKIEGKGPVAEINFTVTLPEWLVEQVQSGSTVF<br>LTQKEKMRFVLELARKNVAQETGGPFAAAVFSLESGELVSAG<br>VNVVVESRCSSAHAEVVALSLAQKAVDSHDLGAAGLPRMVLV<br>SSAEPCAMCMGAIPWSGVKQVICGARDEDVRSVGFDEGAKPL<br>EWVEDFAERGIEVIRDVLREEATEVLWDYERGGEIY |

TABLE 13-continued

Amino acid sequences of deaminases

| SEQ ID NO: | Gene name | Species | Sequences |
|---|---|---|---|
| 91 | pYY-BEM4.18 | tr\|A0A2U0T9B4\|A0A2U0T9B4_9RHIZ | METAELISRLLDVIEKDIAPVTAKGVARGNKLFGAAILKKSDLAVIVAETNNEIENPLWHGEMQAIKRFFELPADQRPATRDCLFLATHEPCSLCLSGITWSGFDNFYYLFSHQDSRDGFAIPYDIQILKSVYAVPEPETGTVSPARDLYNRSNDFWTSHGLQDMIAGLARSNREALLARIDDLNALYAELSERYQRDKGGKGIPLP |
| 92 | pYY-BEM4.19 | tr\|A0A2K9PN08\|A0A2K9PN08_9FLAO | MSDKKESKIKISKTSESIELDEIHSLLSYSIVQKFWENDDRNGRGYNVGVILVDENKNIVDWDINSVNKTENSTQHGEMRLISRYLDKDELYSLKGYTMYPTLEPCAMCAGMMTMTNVYRTVNGQMDYFYSKALERLSIDTRECGGYPPYPRTVISEISPSSISTRLDAEYKQYTNAGNKPIITKFLSTYKAKTIYDDAFNQFINFKCKFPENKTKYENAIKFYNSLPESI |
| 93 | pYY-BEM4.20 | tr\|F4PWM7\|F4PWM7_CAVFA | MRFSLSLLFVILSVLLAGVLACKDPYNPETVDYGQCASATKANYEVRSDSKVLTPADLPADELAVHESRMRHIIDIARVNNKKFVSSIYFPNGTLACIGINTGKPNMIAHGEIVAIQNCTEIHGISMYTNYSIYTTGEPCSMCASAILWSRFKTVVWSTYNSDLYCKICMSNIPIDSSYIFSRAYGLGIEAPVAIGGVVKAEGDAWFGTYCNRPTSIYYIAPKCACQDPAKVSPLKFTQTRTTVWVEGGDKVVTQWNAIISNPSNSTIVDPPIVISPSVVFKGAPWGISAASEPNTYKLSYNKVLFPGQTFSFGYSVYGLEEVAFTALEA |
| 94 | pYY-BEM4.21 | tr\|U7QZM1\|U7QZM1_PHOTE | MNKTRRKLLATLGIMSISMSFIAQAGEKKTQVINNILSKQEITEHEKYMREAIKEAIKNPKHPFGAVIVNRNNGEILSRGVNTGRNNPILHGEIQAINHYITQYGNQGWENVALYTTGEPCSMCMSALVWIGIREVIWATSISVIRNSGIRQIDISAHEIAERASSFYNPITLVGGILANETDKLFLERKRGN |
| 95 | pYY-BEM4.22 | tr\|A0A081CH48\|A0A081CH48_PSEA2 | MASRRHLLATQVTGNHRKLSLWHLRGWLSPYTKLVDAVYFLTTNSFYHSLQTPPVQSITMLLSSIITSLALAAQASAYREGLHPEFQSGLSINSVPATDRDHWMRLANSAIYYPPVSHPCPQAPFGTAIVNTTSNELICAIANRVGSTGDPTQHGEITAIQHCTNVMRKKGLSPQEIIAAWKQLSLYTNAEPCTMCLSAIRWAGFKEVIYGTSVGTISENGRNQIYIPSNLVLEKSYSFGHATLMLGNILTHETDPFFQHQFNESAPCPVGCERTQVGEARVKTCEPVPNWQKLVRLEYSEDSRVGSEPVAHTPLHLEL |
| 96 | pYY-BEM4.23 | tr\|A0A3D3HMU1\|A0A3D3HMU1_9GAMM | MDYSDAILGAITSIRRNSKQPGVNVTDNVTDSSTQYNNDEYWMRRALALAREAGEAGEIPVGAVLVKDNQQVAGGFNQPIRSHDPAAHAEILTLREAGAVLGNYRLIDTTLYVTLEPCMMCAGALVHSRIKRLVFGAAEPKTGAAGSFIDLLTLPRLNHYMEVTGGVLGEECSVLLSDFFRRRRAEKKALKRQNSESGSDSAS |
| 97 | pYY-BEM4.24 | tr\|A0A1N5WT13\|A0A1N5WT13_9ACTN | MLEKIERRLVAAAEAVVRSPSTGDAHTVAAAMDANGDIYSGVNVFHFTGGPCAELVVIGSAAAANAPPLITIVAVGDGDRGVIAPCGRCRQVMLDLHPDVFVIVPTGDGQLAAKPVRELLPFGYVARTGSTAPRVVYFHPRHYDTISSGLKTATVRFQDSVQTGPAVFVFDDGESIRRLDAVVEKVESRRLDHLTEEDAHHEALPDSDALRDAIKTQYPMLGDGDVVDVATFRLTAISAPDPDPRSSYPPAVSRCNPAGPRADLLVGQS |
| 98 | pYY-BEM4.25 | tr\|X0SAC5\|X0SAC5_9ZZZZ | MTKDGRVIASAHDTEVTDQDSTAHAEINAIRKASKIYRKDLTGCLIISTHEPCPMCTGSIIWSNISKVVYGVSIRDSIKAGRDMINLSCKEIIKKPNAEINIYDGILKKECLKLYNNDTRKLVKKFRKYEWINIEENLLNKRMQWFENNKTMIRKLKGNDLEKAYHLILMKIGIKRSEAPIVKKSESKIIFHSKNYCPSLEACIILDLDTREVCKEIYERPTEELIRRLNSKLRFTRNYDCIRPYSDYCEEIIILEK |
| 99 | PYY-BEM4.26 | tr\|A0A3B8IC10\|A0A3B8IC10_9BACT | MPSHEDFIHQCLELGKEALLQGNPPVGSVIVWQDQVIGRGIENGRSSGDITQHAELLALQEAVATGQRDKLKEAIIYSTHEPCVMCAYPIRQYKIPTVVYSVAVPELGGHTSSWHLLTTEDVPKWGKAPKIITGISAEEVEALNAAFQDSLKKG |
| 100 | pYY-BEM4.27 | tr\|A0A2N9P8B9\|A0A2N9P8B9_9FLAO | MFIFKLISPPVSIEVYQDKIIQKLYICFMENIFTDEYFMKKALQEAETAFQQGEIPVGAVIVIDNRIIARSHNLTEMLNDVTAHAEMQAITASANFLGGKYLKDCTLYVTLEPCQMCAGALYWSQISKIVYGATDEQRGYRAMGAQLHPKTKVISGIMQNECTHLMKDFFKQRRSKSTKD |
| 101 | pYY-BEM4.28 | tr\|K1KX30\|K1KX30_9BACT | MVKNPVNNNELYFGKHSEIPMNEEQKAYMKMAVDLSRSGMESGKGGPFGCVIVKDGKVIGIGSNSVLETNDPTAHAEIVAIRDACRNLGHFQLDGCEVYTSCEPCPMCLGAIYWARPSKVFFANDKRDAAEAGFDDDFIYQELELPYEKRKIPFEQGMQDTAKEVFQEWILKEDKTLY |

TABLE 13-continued

| SEQ ID NO: | Gene name | Species | Sequences |
|---|---|---|---|
| | | Amino acid sequences of deaminases | |
| 102 | pYY-BEM4.29 | tr\|R4XI84\|R4XI84_TAPDE | MSSEIEPPSTDVHKHAVAEAADESGAADAFMQIALQQAETALLNKEVPVGCVFVHQPTGTVLATGANQTNASLNGTLHAEFVAIESILRDHPPSIFRESDLYVTVEPCVMCASALRQLQVRKVYFGCGNDRFGGCGSVFSIHSDASKTGDAAYMVESGIFRKEAIMLLRRFYLLQNESAPKPALKSTRVLKEHFDE |
| 103 | pYY-BEM4.30 | tr\|A0A239CVF7\|A0A239CVF7_9DELT | MSPASKKHFPSLFSFLLLTIGLICGTAHAQPQGHTADDTAATLANASLKEHEPFIRRCYQLAIDAGKKGNHPFGALLVHKGKIVLEAENTVLTDNDFTNHAEMNLIAEAARTLSRQIIPEATVYTSCAPCAMCTATLAMAGFTRIVYGVSHDALNKRFGLKGKSVSCPALFKTMGMELEFVGPVLEKEGLRVFDFWPEKDPHAQMLKKQARK |
| 104 | pYY-BEM4.31 | tr\|A0A1Q3NME1\|A0A1Q3NME1_9BACT | MTEFNYDWAKLAFSSKRPLTNLKATFIIAPREISEKRFTQLLKEYLPKGDILLGISKEDYVEGLEGQPQFAMLQQKTLQKLIDKVNDASAHKVYTLRYFQRELPAIIEKLTPPRVVGIHGSWHHSFHTLPIYYLLSEKRIPYQLVAAFSDEDEARAYEVATDKKIVRPTLEGSFDDTTVLQLTDEVAKSSYDYGFQTGAILAEKVNGVYQPVAAGFNKVVPYQTYALLNGASRETNFSPANDMNHYDTIHAEMQILVEAAKQGISLKDKTLFVNLMPCPSCARTLSQTELSEIVYRIDHSGGYAVDLLTKVGKDIRRIVY |
| 105 | pYY-BEM4.32 | tr\|A0A2G6N4N7\|A0A2G6N4N7_9DELT | MKERTVSYSDRHFMAEALEMAESALTQGEFPVGCVIADGTAVVARGHRTGTTAGAVNEIDHAEINALRHLGLAGEHLDRTDLTIYSTMEPCLMCFAAIVLSGINRIVYAYEDVMGGGTGCDLTGLPPLYRDAPLTLVAGVRRRASLNLFRRFFTDPENGYWAGSLLSRYTLNQTKDSHRL |
| 106 | pYY-BEM4.33 | tr\|A0A0G0RBB8\|A0A0G0RBB8_9BACT | MQSVQYNKLTHLQRRALDEAEQVLENSYNPYSHFYVGACLISEDEQLIAGTNFENAAYGSAICAERAAVLRANAMSIRRFRGIAIIARGEDFNTTEVTGPCGSCRQVLYEISQVSGCDLQVILATSKKDKIVITTIRELLPLAFGPLDLGVDIGKY |
| 107 | pYY-BEM4.34 | tr\|A0A327L2Q5\|A0A327L2Q5_9RHIZ | MVTSRDGEDEAMMARCVALSRIAVGKGEYPFGAVVAREGRIVAEAINRTIRDGDVSRHAEVIALARAQKAIGRRELRECSLYSNVEPCAMCSYCIREAWVGRVVYALGSPVMGGVSKWNILRDDGLSGRMPQVFDAAPEVVSGVLVEQAQAAWRDWSPLAWEMITLRGLMTDPSARPECRTRAARPRSLWHHLVALIERPPRPYVDPTSAAEGHADL |
| 108 | pYY-BEM4.35 | tr\|S2DR30\|S2DR30_9BACT | MKMKKKIEITVSLEVIQKSEWSKEDRSLIERAIHAVEHAHAPYSNFMVGTALLLDNGQIFSANNQENVSFPVGICAERAVLSYAMGNFPNNRPVKLAVVAKRRSDSTWATVTPCGLCRQTINEYEVKFGHPIEILMLNPGEEILKASGIDQLLPFRFNDLNS |
| 109 | pYY-BEM4.36 | tr\|A0A369QGF1\|A0A369QGF1_9BACT | MEEHEKWMHWCLNLAQQALQQGDFPVGAVVVQKGKLIGQGVEAGQLKKDITCHAEMEAIRDARQTINTADLQNCILYSTHEPCIMCSYVIRHHKISRVVVGTTVPEVGGSSSAYPLLSAPDISIWVAPPHLVTGVLAEACQALSQAYKQKFKK |
| 110 | pYY-BEM4.37 | tr\|A0A1W6X4U4\|A0A1W6X4U4_9RHIZ | MTNPSRQERWDRRFLELAKVFGTWSKDRSAGTGCVIVGPDRLLRASGYNGFARGIDDEVPERHERPAKYSWTEHAERNAIYNAAKLGISLDGCTAYVNWFPCIDCARAIVQAGIVRLVGLHPDHADQRWGSEFKFATEMLRESGIEIILYDIPELAARK |
| 111 | pYY-BEM4.38 | tr\|A0A238BW09\|A0A238BW09_9BILA | MEEMARKIRTKAKKANSYCNTMTFLISKASIVLLKAECKRIELTVVIFRFLIKMNASEPNNELCDMTVIKSMLKITHVIFDLDGLLIDTEVVFSKVNQCLLSKYNKKFTPHLRGLVTGMPKKAAVTYILEHEKLSAKVDVDEYCKKYDEMAEEMLPKCSLMPGVMKLVRHLKTHSIPMAICTGATKKEFEIKTRYHKELLDLISLRVLSGDDPAVKRGKPAPDPFLVTMDRFKQKPEKAENVLVFEDAANGVCAAIAAGMNVIMVPDLTYMKIPEGLQNKINSFSDNLIISNDLNVALMSLKKELSEEEVHFLNRAFEIAVDAVLNNEVPVGCVFVFEGQEVAFGRNDVNRTKNPTYHAEMVALKMMKQWCMDNGRDLEEIMRRTTLYVTLEPCIMCASALYHLRLKKILYGAANERFGGLVSVGTREKYGAKHFIEIMPNLSVDRAVKLLKEFYEKQNPFCPEEKRKVKKPKKSGNNNDNSDDAVALNV |
| 112 | pYY-BEM4.39 | tr\|A0A1J5H6Z0\|A0A1J5H6Z0_9BACT | MAYQPSEKFMQMAIDKTREGVLSGQTPFGACIVKDGKVVACEHNTVWQDTDITSHGEVHTIRAACKAIGSIDLSGCILYSTCEPCPMCFSAIHWARIDTVVYGAFIADAQDAGFNELTISNEKMKEFGGSPVNFISGFMRDENVALFKLWKEQGANNVY |

TABLE 13-continued

| SEQ ID NO: | Gene name | Species | Sequences |
|---|---|---|---|
| | | Amino acid sequences of deaminases | |
| 113 | pYY-BEM4.40 | tr\|A0A3C2D945\|A0A3C2D945_9BACT | MKTTEIRIIVHEYQNIDELTENDQYLLHEARRITEFAYAPYSGFHVGAAILLGNGMIVKGNNQENSAYPSGLCAERVALFYANANYPDSEVKTIAISAAKNGILVNDPIKPCGGCRQTLSEAEVRFGSPIRIILDGQDSILVLHGVESLLPLSFSKKDLASPLAATGR |
| 114 | pYY-BEM4.41 | tr\|A0A1I7EYS3\|A0A1I7EYS3_9BURK | MKFKLDPSRPPDEDDYYLGVALAVRRKANCTGNRVAAVIVKNKRVIATGYNGVPEDMPNCLDGGCLRCSNPGGQFKSGTRYDLCICVHAEQNALLTAARFGISVEGAHLYTTMQPCFGCAKEILQAKIEKVFYLHPWVPTDVDPVMDAAMKAEYAKIIGKLKVKKLDFDDPVATWAVTTMRQAALASDKNPDKKTPPKTAKKKVAKKKSRTSPR |
| 115 | pYY-BEM4.42 | tr\|H8GQX8\|H8GQX8_METAL | MNHEHFMRRAIELARQAPQYPFGAVIVRRDDGQCVGQGFNRSDLNPTYHGEMVAINDCAVRHCAEDWRGFDLYTTAEPCAMCQGAIEWAGIGRVFYGTSIPYLQKLGWWQIDLRAAEVSARAVFRDTLIVGGILETECNALFAAARRGCFGTGSE |
| 116 | pYY-BEM4.43 | tr\|A0A0S8HZN3\|A0A0S8HZN3_9CHLR | MDEHDIRFLRASFDVARNARKNGNHPFGALLVDEHGRIVMEAENTVITAKDCTGHAETNLMREASSKYDSDFLANCTIYTSTEPCPMCAGAIFWSNVRRVVYGLSEESLYEIAGRGSEEVLFLSCREIFERGKKLIEVIGPLLEDEAREVHMGFWR |
| 117 | pYY-BEM4.44 | tr\|E3SF31\|E3SF31_9CAUD | MKPTTVLQIAYLVSQESKCCSWKVGAVIEKNGRIISTGYNGSPAGGVNCCEHAEEQGWLLNKPKPVLIPGHKSECVRFSQVDRFVLAKAHREAHSAWSKNNEIHAELNAILFAARMGSSIEGATMYVTLSPCPDCAKAISQSGIKKLVYCETYDKNIPGWDDILKNAGIEVFNVPKRSLDKLNWENINEFCGE |
| 118 | PYY-BEM4.45 | tr\|F8AAC6\|F8AAC6_THEID | MIRAPWHEYFMLLAKIVALRSGCNSRPSGAVIVKNKRILATGYNGPMPGAWHCTDRGPGYCFRREKGIPDIDKYNFCRATHAEANAIAQAARFGISVEGASLYCTLAPCYVCLKLIASAGIKKVYYEHDYGSRDFERDQFWKEAIKEAGLEKFEQITVSQEVMEQLQEILPYPTSKRRLAPTEFLDEFEDGKKYGVPSIEVLFNKLNYLTRQALKDITFVIEKTTVTEEPEGISFYLSGKMVELSELINTVKKQINADQNFYFLAKHNAIEAKIEILREAENIRLKAFLNECPLESFKRIAESLDYILYQVSNSLSLPTRLELSVNLLRI |
| 119 | pYY-BEM4.46 | tr\|A0A2H4ZNK4\|A0A2H4ZNK4_9EUKA | MKKQLSRKIQEEWMSRLLRNAYDAGTYGEVPIAAVILNESGQCIGWGRNCREKDQNPLGHAEIIALRQASYLKKSWRFNECTMLVTLEPCPMCAGALLQARINHIIYGASDYKRGGFGGVLDLSKNSSAHHKIEITRGVKSIQSCQLLETWFRRRRRV |
| 120 | pYY-BEM4.47 | tr\|A0A239N5N1\|A0A239N5N1_9PSED | MEGRAGIIPFDEGGAAMGPAEEDSPMQHLAYMREALALARANVEAGGRPFGAVLVRDGEVIARAANGTHLDHDPTAHAELLALRAAGRALGSPRLDGCVVYASGHPCPMCLAAMHLSGVSAAYYAYSNADGEPYGLSTAAVYAQMAQPVEWQSLPLQALRPEDEEGLYGFWRERRP |
| 121 | PYY-BEM4.48 | tr\|A0A328VTR2\|A0A328VTR2_9PSED | MHPEHLALLQQAPASTHADDTWARLCCEQALLAVEEGCYAVGALLVDGAGELLCSGRNQVFAPAYASAAHAEMRVLDQLEAEHAQVDRRSLTLYVSLEPCLMCYGRILLAGITRVRYLARDRDGGFALRHGRLPPAWANLASGLSVVQAKADPYWLDLAEHAIGRLQDRQTLRQRVIRAWRGQRTLTDEFSSTKRTHSG |
| 122 | pYY-BEM4.49 | tr\|A0A103YG48\|A0A103YG48_CYNCS | YIRELHASSLRRDEHEIQNPKILVIVDRLSSPSLHVSLSLSLSLVIFPPFIPLNQTPTHMENAKVVEAKDGTIAVASAFSGHQEVVQDRDHKFLTRAVEEAYKGVECGDGGPFGAVVVHKDEVVASCHNMVLKHTDPTAHAEVTAIREACKKLNKIELSDCEIYASCEPCPMCFGAIHLSRIKRLIYGAKAEAAIAIGFDDFIADALRGTGFYQKAHLEIKQADGNGAMIAEQVFEKTKAKFAIDHKFLTRAVEEAYKGVECGDGRPFGALVVHKDEVVVSCHNMVLNYTDPTAHAEITAIREACKKLNRIELSDCEMYSSCEPCPMCFGAIQISRIKRLVYGAKAEASIASGIPIGDFISDALKGTGFHEKANFEIKQADGNGAMIAEQVFERTKAMFPKR |
| 123 | pYY-BEM4.50 | tr\|W5M1M8\|W5M1M8_LEPOC | NSSTRESRVMAQMEINGGASPPKKPGKGQSAADQDMITGLINKALQAKEFAYCPYSNFRVGAALMTNDGRVFTGCNVENACYNLGVCAERTAILKAVSEGYESFRAIAVSSDLQDQFISPCGACRQVMREFGTGWDVFLTKVDGSYVRMTVDELLPMSFGPDDLKKKKVFSLQNGHEVSTQFYTHSPCEAGENNN |
| 124 | pYY-BEM4.51 | tr\|A0A3N5YPZ2\|A0A3N5YPZ2_9ALTE | MSNSETEHIQALVDAAQAAQKQSYSPYSSFQVGAAIFADDGNTYSGCNIENVAYPLGQCAEATAIGMMIMQGAKRIEDIMIASPNDQVCPPCGGCRQKISEFGTAETKIHMVTRSGEVSTVTLGELLPLAFDSL |

TABLE 13-continued

Amino acid sequences of deaminases

| SEQ ID NO: | Gene name | Species | Sequences |
|---|---|---|---|
| 125 | pYY-BEM4.52 | tr\|A0A2A9NC86\|A0A2A9NC86_9AGAR | MTNSTLSNEDRTRLIQGAFQARKKTYSPYSNFPVGAALLTTDGRIIEGANIENASYGGTICAERTAIVKAVSDGYRHFAGIAVTTKMPTRVSPCGICRQVLREFCSLDMPVLLVPGDYPQRNPVDDDGADKPGVITEGGVRETTLGALLPDSFGPENLPPRA |
| 126 | pYY-BEM4.53 | tr\|A0A2D6RD43\|A0A2D6RD43_9GAMM | MNIENLITENDETLIRRCIELAGESVKNGDKPFGALLAKDGNIIFESSNNAKTKVPYHAEILTLMDAQDKLNTTDLSDYALYSNCEPCPMCSFMIREYKLDKVVFSVHSPYMGGQSRWNILEDDVLTRFKPYFSKPPNVVGGVLESEGKRIFDKVGLWMFGKE |
| 127 | pYY-BEM4.54 | tr\|A0A0H3AVL6\|A0A0H3AVL6_BRUO2 | MHAKGYSQQERRIIPFANRFRFRELCSNKSLHGLRAKFPEQYTKWDPMRKAASITKANSATPMDIALEEAHAAGERGEVPIGAVIVRDGEIIARAGNRTREFNDVTAHAEILTIRQAGEMLGSERLIDCDLYVTLEPCAMCAAAISFARIRRLYYGASDPKGGGIEHGGRFYTQPTCHHAPEIYPGFCEADARKILKDFFREKR |
| 128 | pYY-BEM4.55 | tr\|A0A242H531\|A0A242H531_9ENTE | MFIVKNNIEVIQQQAELDAKFMKQALKLAKDASNNGNEPFGAVLVKNDKVILTGENQIHTESDPTYHAELGIIRDFCTSQKITDLSEYTLYTSCEPCCMCAGAMVWSNLDRMVYGLGHDELAEIAGFNIMIGSEEIFSKSPNRPEVAKGVLKEAAVPVYVDYFQR |
| 129 | pYY-BEM4.56 | tr\|A0A2R6XZE2\|A0A2R6XZE2_9BACL | MSGRISWHEYFMAQAKLIALRATCTRLMVGAVIVRDRRVIAGGYNGSIAGDEHCIDVGCKVRDGHCIRTIHAEQNALMQCAKFGVSTDGAELYVTHFPCLNCTKLLIQAGIRHIYYEVPYRVDPYAIELLEKAGVGTTQITVDLNAYVQVMSKVSTDPALTYVPESKAQKDEYGQSVGKIV |
| 130 | pYY-BEM4.57 | tr\|A0A139SHT6\|A0A139SHT6_9BACT | MSEANASSESLPSRNSPVELIAEAAGKFGRRPTWDEYFMATAVLISTRSSCERLNVGCVIVTAGESHKNRIVAAGYNGHLPGSPHTSRMRDGHEQATVHAEQNAISDAARRGSSVEGCTAYVTHYPCINCAKILASAGIAKICYRLDYHNDPLVKPMLAEAGIEIVQLGEAAS |
| 131 | pYY-BEM4.58 | tr\|A0A261DBH2\|A0A261DBH2_9RICK | MVMKKKLITVKRSTEFNNFFMEEALKQAQFALDKNEIPVGAIIVNRITNKVIAKAHNIVEQTKNPVLHAEIVAINQSCQILSSKNLSDCDMYVTLEPCVMCSGAISFARIGRLFYAANDPKQGAIENGGRFFNSKSCFYRPEIYSGFSAKISENLIKEFFYNVRYQKCNP |
| 132 | pYY-BEM4.59 | tr\|A0A2N0XZK6\|A0A2N0XZK6_9VIBR | MTDNSLHESYMRQAFELSKSALPGCRPNPPVGCVFVKDGEVVSSGFSQPPGNHHAEAGAIAAYTGSYDGLVAYVTLEPCSFQGRTPSCAKALVRVRPEKVYVAILDPDTRNSGAGIKILEDAGIDVEVGLLGEEVASFLNPYLIRN |
| 133 | pYY-BEM4.60 | tr\|A0A1V5R0F9\|A0A1V5R0F9_9BACT | MTKKETTKLHALDDFCMKKALLLAKRAFRADEVPVGALVVDSSNKVIGRGYNQVEKRKSQRAHAEQLAIEQACKKIGDWRLEGCTLYVTLEPCTMCMGLIKLSRIERVVFGAASPLFGYQLDKNRKSQLYKKGVIKIRKGVGKATAAALLKDFFKNKRM |
| 134 | pYY-BEM4.61 | tr\|A0A2W0H8Y3\|A0A2W0H8Y3_9BACI | MKNNGRLDHEYFMTEALQEAKEAGQRGDLPIGAVIVHNGRIIARGSNMRKTAGIKISHAENNAMHNCAPYLMKHASECVIYTTLEPCIMCLTTLVMANIDSIVFAADDKYMNMKPFIDANSYIRDRIHQYKGGVCRGESEALLRKYSPYAAELALNGTHPHHRKGGA |
| 135 | pYY-BEM4.62 | tr\|A0A261BDB7\|A0A261BDB7_CAERE | LYKLYIFRMTTTKANLTQFEQELVDKAVGAMEKAYCKYSGFKVGAALVCEDGEIIIGANHENASYGATICAERSAMVTALTKGHRKFKLLAVATELEAPCSPCGICRQYLIEFGDYKVILGSSTSDQIIETTTYGLLPYAFTPKSLDDHEKEAEERNHQEGEKKH |
| 136 | pYY-BEM4.63 | tr\|A0A2E1PHI6\|A0A2E1PHI6_9GAMM | MKELLIHSWLMLNSNSKLIMERVIELSEINLKNGKIPIAAVIVDKKNYEIISESQNEDSPIGHAELLAITKALKKLNTNRLDSTNLFVTIEPCPMCAYAISKCHINRLYFGSEDEKGGGVINGPRIFESHNLKKIDYVSHCYHEKTTQLMQSFFQLKRNQQL |
| 137 | pYY-BEM4.64 | tr\|A0A378LUA7\|A0A378LUA7_9GAMM | MDTIIKKMISNAHNTLAHSYSPYSKFSVASCICTDKDNFYTGVNVENSAYGLAICAETSAISAMVTAGEKRIKSMVVMAGTNILCSPCGACRQRIYEFSTPDTLIHLCDKNSILRTFKINELLPEAFKFDFNP |
| 138 | PYY-BEM4.65 | tr\|A0A139HQ78\|A0A139HQ78_9PEZI | MADSLKSKPGHARHDTALIHGLSQSDVQKLSESCVDAKSKAYCPYSHFRVGCAVLLANGDVVQGANVENAAYPVGTCAERVALGTAVGAKKGDFRALAVSTDISPPASPCGMCRQFIREFCELNTPILMYDKDGKSVVMTLEQLLPMSFGPDKLLPPGQLENGLMQTQTQSSFVTRAFSTTSSRRQDDTPQVPQSHYDFFPQTFPQGPPPKTSFSPDLKQLRKEFLQLQAKAHPDLAPQDQKRRAEALSMRINEAYKTLQSPLRRAQYLLSQQGIDVEDETAKLDDSSLLMEVM |

TABLE 13-continued

Amino acid sequences of deaminases

| SEQ ID NO: | Gene name | Species | Sequences |
|---|---|---|---|
| | | | EAREAVEEVEDEEQLNEIRAENNGRIEESVRVLEDAFRDNEF EKAAQEAIRLRYWVNIEESIQGWEKGNGGGILHH |
| 139 | pYY-BEM4.66 | tr\|A0A2A9FXV0\| A0A2A9FXV0_9VIBR | MCNLKENKDMDKYFHFACDATIEGMREGTGGPFGATLTRNGE VVCSVANTVLKDMDISGHAEMVAVREACKKLDTLDLSDCVMY ATCEPCPMCVSVMLWAGIKTCYYASTHLDAAKHGFSDQQLRD YLDGSDTSTLNMVHIEDNRDDCAKIWTEFRHLNETKNDG |
| 140 | pYY-BEM4.67 | tr\|A0A1A8AG96\| A0A1A8AG96_NOTFU | MEHSDRWSRAEPGLSTSSRETRDGSTQTDCKLQGHGPRLSKV NLFTLLSLWMELFPQEQDEENGQSQIRRSGLVVVREGKVVGL HCSGADLHAGQAAILQHGASLANCQLFFSRRPCATCLKMIIN AGVRQITFWPGDPEISMLTSNQTHSQRTSQSITEASLDATAV EKLKSNSRPQICVLMQPLAPGVLQFVDETSRRSDFMERMMDD DPELDSEKLFNSDRLRHLKDFCRHFLIQTDQRHKDILSQMGL KNFCVEPYFSNLRSNMTELVEVLAAVAAGMPQQHYGFYREES LSLDPHPVDVSQAVARHCIVQARLLSYRTEDPKVGVGAVIWA KGQSACCCGTGRLYLIGCGYNAYPAGSKYAEYPQMDNKQEDR ERRKYRYIVHAEQNALTFRTRDIKPDECSMLFVTKCPCDECI PLIRGAGVKHIYTSDQDRDKDKGDISYLRFGSLKGVCKFIWQ RSPPVSSASSLHLTNGCVGKHVRQAEQQIYKNKKLCTKGSSG SSDIC |
| 141 | pYY-BEM4.68 | tr\|A0A3E2VN88\| A0A3E2VN88_9FIRM | MEKEITNMDKQKLIQMAVDGLGRSYAPYSHFHVSAALLCADG TVYTGNNIENAAYTPSVCAERCAIFKAVGDGRREFEAIAVCG GPDGVIEDYCPPCGVCRQVMREFCDPSSFRVLVAKTAEDYRE YTLEQLLPDGFGPDHLTGSGER |
| 142 | pYY-BEM4.69 | tr\|A0A2D5ZRJ2\| A0A2D5ZRJ2_9BACT | MARPVHLHTGERRTEEGATESRAVAAVATAITRAPRAPPRPA TGRERDGPPPRRVFGGGLRVGDPSGYDRGESKPIGGPLTEKR SDWHSYFMRIAGEVATRATCDRKHVGAVIVRNRTILSTGYNG SIRGMPHCDDVGHDMVDGHCIATIHAEANAILQAARNGVMIQ DGSIYITASPCWNCFKLVANAGLKRVYYGEFYRDKRSFEVAR RLGIDLMHIEV |
| 143 | pYY-BEM4.70 | tr\|A0A1B8WPS3\| A0A1B8WPS3_9BACI | MEGVQLIYQFQWGNLIMTVNKEDLYLIDVARNTIKTLYVDGK HHVGAAVRTKTGKIYSAVHLEANIGRVSVCAEAIALGKAISE GESEFDTIVAVRHPDPTQENQKIEVVSPCGICRELISDYGKG TNVILKNKEGYIKTVISDLLPNKYIREDN |
| 144 | pYY-BEM4.71 | tr\|A0A1W5ZQK9\| A0A1W5ZQK9_9BACI | MNRFMERAVSLAAENVRVGGQPFGAVLVKDDELVAEGVNEMH LNYDVSGHAELLAIRRAQGELQTHDLSGYTMYASGEPCPMCL SAMYFAGIKDVFYCATVEEAAQVGLEKSKNVYDDLQKSKGER SLVMKQMPLEDDQEDPMKLWDERTNHNGTS |
| 145 | PYY-BEM4.72 | tr\|A0A378V0W4\| A0A378V0W4_MYCFO | MVHAQFDPTARQALAATAVEAKTRKDLTWQQIADAAELSPAF VTAAVLGQHALPARSAEAVAALLGLDDDAALLLQTIPIRGSI PGGIPTDPTIYRFYEMLQVYGTTLKALVHEQFGDGIISAINF KLDVRKVADPEGGERAVITLDGKYLPPNPFDRVRYRGGLMDF AQRTIDIARQNVAEGGRPFATVIVKNGEILAESPNLVAQTHD PTAHAEILAIRKACTRIGTEHLIGATIYVLAQPCPMCLGSLY YCSPDEVVFLTTRDAYEPHYVDDRKYFELNMFYDEFAKPWDQ RRLPMRYEPRDAAVDVYKLWQERNGGERRVPGAPTSTRPGKN PRGE |
| 146 | pYY-BEM4.73 | tr\|I3XF03\| I3XF03_RHIFR | MKQRCMSPKSAQRFWDNDMHNNKDRPMSENELFVAAREAMAK AHAPYSKFPVGAAIRAEDGQIYTGANIENLSFPEGWCAETTA ISHMVMAGQRKIMEVAVIAEKLALCPPCGGCRQRLAEFSGAS TRIYLCDETGIKKSLALSDLLPHSFETEILG |
| 147 | pYY-BEM4.74 | tr\|F8IEF3\| F8IEF3_ALIAT | MDAKELETRGWLCMRAVDVIDKKRRGEALAEEELRFLIEGYV AGRIPDYQMSAFLMAVVWRGMTREETLVLTRLLADSGERLDL SGIPGVKVDKHSTGGVGDKATLVVLPLVASIGVPVIKMSGRG LGHTGGTIDKLESIPGFRTDLSVAELVAQVRQVGIALGGQTA DLAPADKKLYALRDVTGTVESLPLIASSVMSKKLAGGADAIV LDVKVGDGAFMKSRSDARRLARLMVEIGEAAGRRTVAVLSNM DQPLGCAIGNALEVAEAIRVLSGEGPFDLAEIALALAEEMTV LAGVAATREEARRMLRQSVAEGRALETLRRWIAAQGGDPAVV DDPSRLPQAPVQMPYLPKKAGFVAKLSALAFGLAAMRLGAGR ETKEEAIDPSVGIVLHAKVGDRVQTHRPMFTVHARTGEDALR CIQELEAAIQISDDPVEAPPLILARIDRSEALPYADLMDAAR EARDRAYVPYSGFAVGAALELADGRMVTGANVENASYGLTNC AERSAVFRAVAEGGPGTKPEIRAVAVIADSPEPVSPCGACRQ VLAEFCSPDTPVYLGNLQGDVRETTVGALLPGAFTDAQMANV RRQDKEA |

TABLE 13-continued

| Amino acid sequences of deaminases | | | |
|---|---|---|---|
| SEQ ID NO: | Gene name | Species | Sequences |
| 148 | pYY-BEM4.75 | tr\|A0A1G3M638\|A0A1G3M638_9SPIR | MKTTNINALDKWDLRFLQMAEHVAEWSKDPSTKVGAVIVRPDRTIASVGFNGFARGVRDTVERLWNRELKYPLTVHAELNAILSAHEPVRGHSLYVSPLSPCSNCAGVIIQSGIARVVAKCGQVNNPAQWSESFNLALTAFAEAGVSVILVEH |
| 149 | pYY-BEM4.76 | tr\|A0A3D9LFR2\|A0A3D9LFR2_9MICC | MEQNDHGSSGAFSDPFEDDIPLTASLPRITGTGSGIDWQRLESTARAAMTRAYVPYSRFPVGAAALVEDGRVVAGCNIENASLGLTLCAECSLVSNLQMSGGGRIVAFYCVDGNGEVLMPCGRCRQLLYEFHAPGMRLMGPDGELTMDEVLPLAFGPADMTHLSDSAASTDDPGRTR |
| 150 | pYY-BEM4.77 | tr\|A0A3B9YGB5\|A0A3B9YGB5_9BACT | MAKPISKKYRKLIETAKAARKKAYSPYSRYQVGAAVLTESGRIYSGANMENASYGLCMCAERVAIANAVTRGEKVLQAVCVVGKKARPCGACRQVMLEFSTKETELLMVDIDPNARRDTVIRTRVYSMLPNPFDPFESGMLPQHPQNLLRRRKSPQPRRKRRSRPVHREVSR |
| 151 | pYY-BEM4.78 | tr\|A0A182F569\|A0A182F569_ANOAL | MPRPSQFRVSSSQSLSNSQIQASQSSDSVVDITSYVNAVVKALLNLSCTKTIIKRADLVNIALKGNGRLIGRVLQDANIELKEIYGYELIEVEKSKTMILCSTLAAGSMDELNDANRRRYTFLYLILGYIFMKNGSVPETIVWEFLETLGIEEQQEHNYFGDVRKLYDSLFKQAYLTRTKQALEGLNDDVMLISWGVRSKHEVSKKDILAGFCKVMNRDPVDFKAQYIEANEKDDKMNNNINGTVDGRNTVEYSSLDASVKELIEAAIKVRNNAYCPYSNFAVGAALRTVGGDIVTGCNVENGTFGPSVCAERTAVCKAVSEGHREFTAVAVVAFQETEFTAPCGTCRQTLSEFSRKDIPIYLVKPSPVRVMVTSLFQLLPHAFSPSFLNK |
| 152 | pYY-BEM4.79 | tr\|A0A264Z0D4\|A0A264Z0D4_9BACI | MEPKKLIEEAIVASKQAYVQYSNFHVGAALLTKDGKLYHGCNIENASYGLTNCAERTAIFKAVSEGEKEFQAIAVVGDTEGPISPCGACRQVLAEFFSPDTVVILANLKGDHVVTNINELLPGFFSSKDLQKKVKNCFEKNALGSSCLRPI |
| 153 | pYY-BEM4.80 | tr\|A0A1L9Q1R3\|A0A1L9Q1R3_ASPVE | MPLSAEEAALVETATATINSIPLSEDYSVASAAKASDGRVFTGVNVYHFTGGPCAELVVLGVAAAAGAAQLTHIVAVANEQRGILSPCGRCRQVLLDLQPNIQVIVGKEGSEQSVPVAQLLPFSYRQPDQHTPVIFKALTSSGPVVVDFFATWCGPCKAVAPVVGKLSETYTDVRFIQVDVDKARSISQEHDIRAMPTFVLYKDGKLLDKRVVGGNMKELEEQIKAIIA |

TABLE 14

| DNA sequence of target sites. | | |
|---|---|---|
| | Target site sequence (5'-3') | SEQ ID NO: |
| A1 | GTATTACTATTATTATCTGAGA | 296 |
| A2 | GTGGGACTGATCCCTTAATGTG | 297 |
| A3 | GAAAGAGACAGAGAAGGGGCA | 298 |
| A4 | GAAGGCTTTACTGTATTACAGA | 299 |
| A5 | GACCAAAACGAGGGACATTTA | 300 |
| A6 | GACCAGGTCAGCAAACATGTT | 301 |
| A7 | GACTCAGCGCCCCTGCCGGGCC | 302 |
| A8 | GAGAAGAAACCAGGGAACAGGT | 303 |
| A9 | GAGAGAGAGCGGGGGCGGTGGG | 304 |
| A10 | GAGTGGGAACTTTCTGATGCCA | 305 |
| A11 | GATGTGTCTACTGTTACTTACA | 306 |
| A12 | GCACCCAGGGGTTCTGCAGAGC | 307 |
| A13 | GCATTCCACTCCGTCCGCCTC | 308 |

TABLE 14-continued

| DNA sequence of target sites. | | |
|---|---|---|
| | Target site sequence (5'-3') | SEQ ID NO: |
| A14 | GCCACAGACTTTTCCATTTGC | 309 |
| A15 | GCCACAGTGGGAGGGGACATG | 310 |
| A16 | GCCCAGCAATTCACTGTGAAG | 311 |
| A17 | GCCCAGCTCCAGCCTCTGATG | 312 |
| A18 | GCCCTGATCTGCACTGAACAG | 313 |
| A19 | GCCTCAAGTCTGGTTATTTTAG | 314 |
| A20 | GCCTGGCAGATGAGAACCAGG | 315 |
| A21 | GCGAAAGGCTCGCGGCGAAGGA | 316 |
| A22 | GCTCCTCTCACCCTTATGACTC | 317 |
| A23 | GCTGCAAGGGTTGGCCAGGCT | 318 |
| A24 | GGAGCCAGAGACCAGTGGGCA | 319 |
| A25 | GGCCTCCGTATCACTCTCTGAC | 320 |
| A26 | GGGTACCTGAGTGGGGTGCATT | 321 |

TABLE 14-continued

| DNA sequence of target sites. | | |
|---|---|---|
| | Target site sequence (5'-3') | SEQ ID NO: |
| A27 | GGTCGACCCTTGGTATCCATG | 322 |
| A28 | GGTCGTAGCCAGTCCGAACCC | 323 |
| A29 | GTAACTGAACCCCTGCAATCAA | 324 |
| A30 | GGCCTCCGTATCACTCTCTGAC | 320 |
| A31 | GCTTTCCTTAGCTGTAAAAGAA | 325 |

Figure 9:
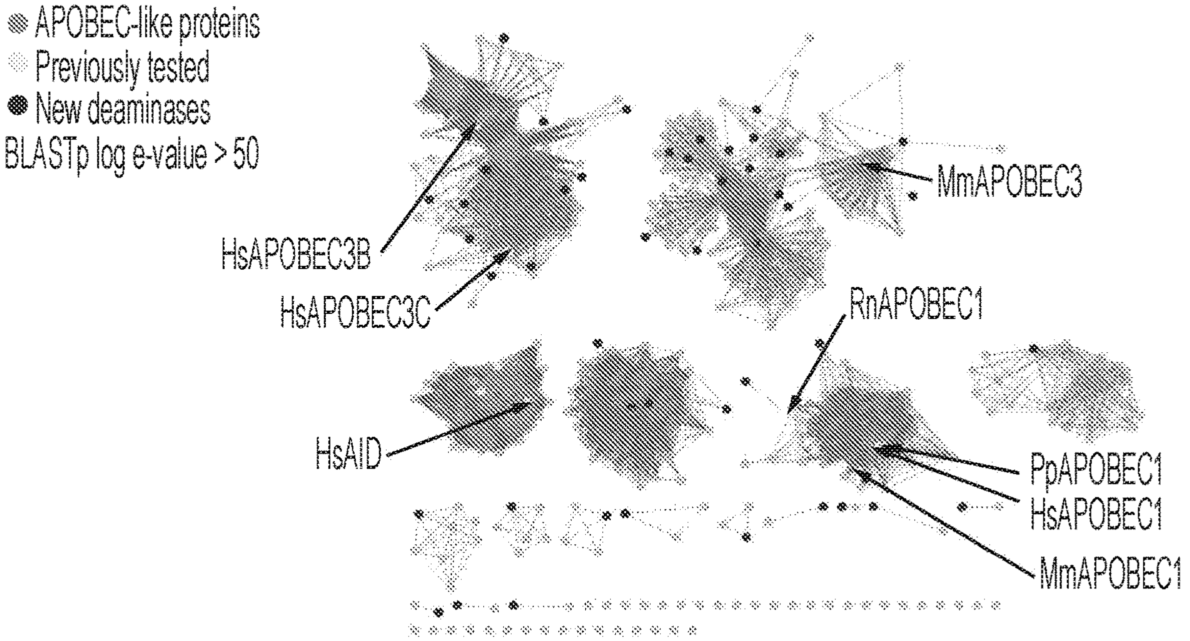
FIG. 9 is a schematic depicting a similarity network of APOBEC-like proteins.

A similarity network was generated from proteins with Pfam domains including cytidine deaminases and ssDNA binding domain (FIG. 9). A total number of 43 deaminases were selected to represent the cluster which contains most of the active deaminases from the first round of screening. Out of this selected set, 33 deaminases showed measurable activity in at least 1 target site indicating that they could be used to build functional base editors. APOBEC1 cluster was enriched with robust deaminases with high in trans activity, while deaminases picked from APOBEC3* cluster were generally associated with less in cis activities but high cis/trans ratio (FIG. 2B). Out of these deaminases, RrA3F (BEM3.14), AmAPOBEC1 (BEM3.31) and SsAPOBEC2 (BEM3.39) showed robust on-target editing activities that are comparable to rAPOBEC1, and greatly improved cis/trans ratio (FIG. 2C). Notably, BEM 3.14 and BEM 3.39 displayed decent activities on GC target (TSP2) while no editing was observed from rBE4. These new CBEs are promising new tools for safe genome editing. A broader screening was also performed by selecting a sequence located in the center of 80 other clusters. But none of these deaminases showed any activities in base editor complex. This systematic study of cytidine deaminase superfamily provided guidelines for selecting alternative deaminases for different purposes.

Figure 10A:
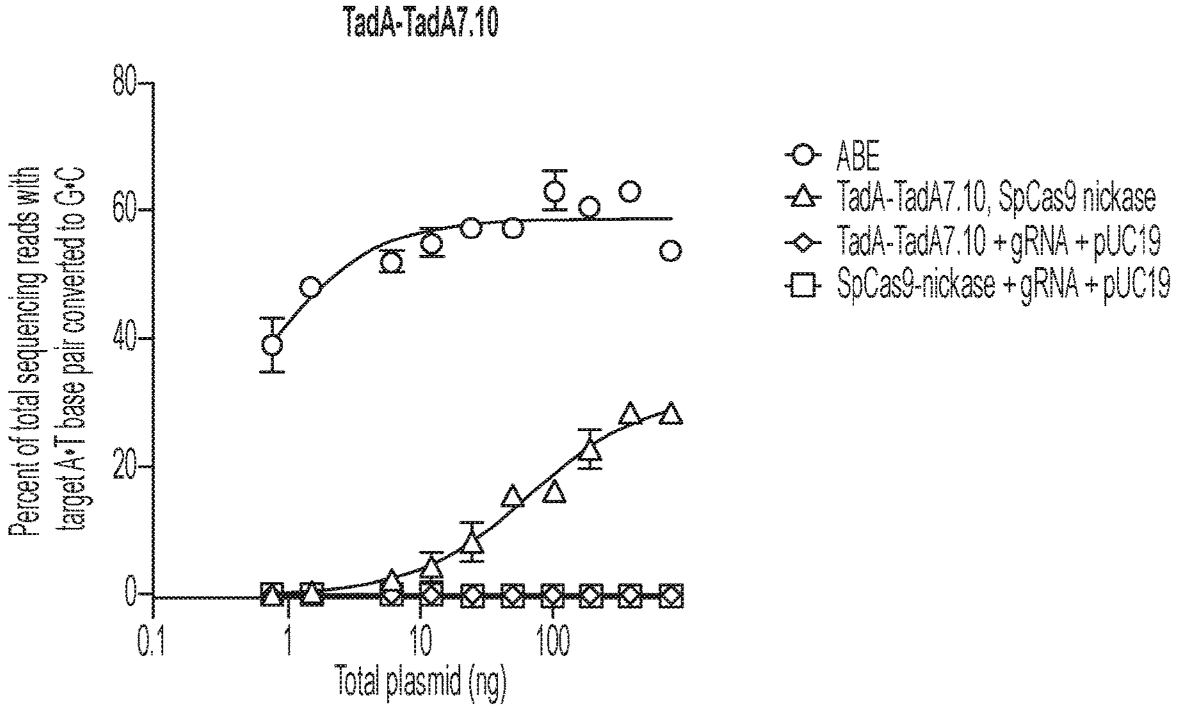
FIGS. 10A and 10B are graphs depicting dose dependency studies on in cis activity and in trans activity in TadA-TadA7.10 and rAPOBEC1, respectively.
Figure 10B:
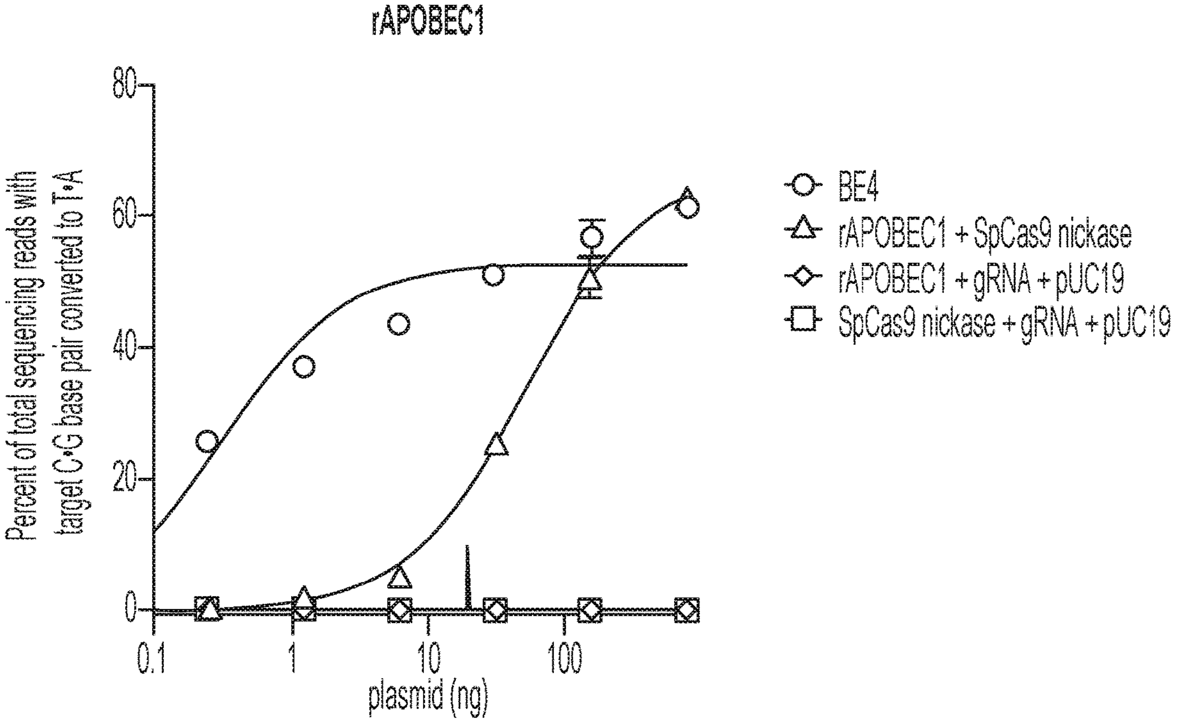
Figure 12A:
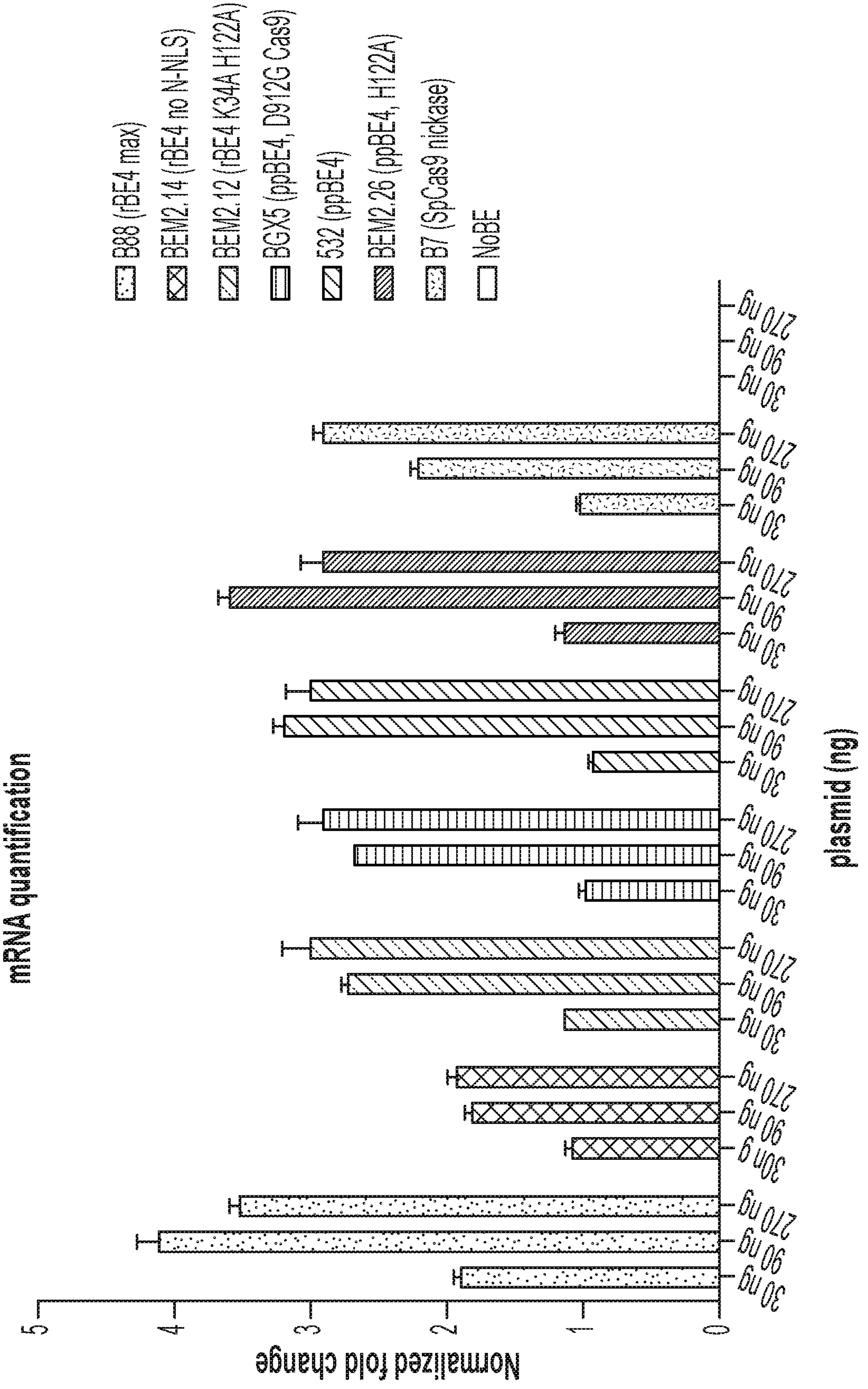
FIGS. 12A and 12B are graphs depicting quantification of base editor mRNA and protein, respectfully, from HEK293T cells transfected with base editor plasmids.
Figure 12B:
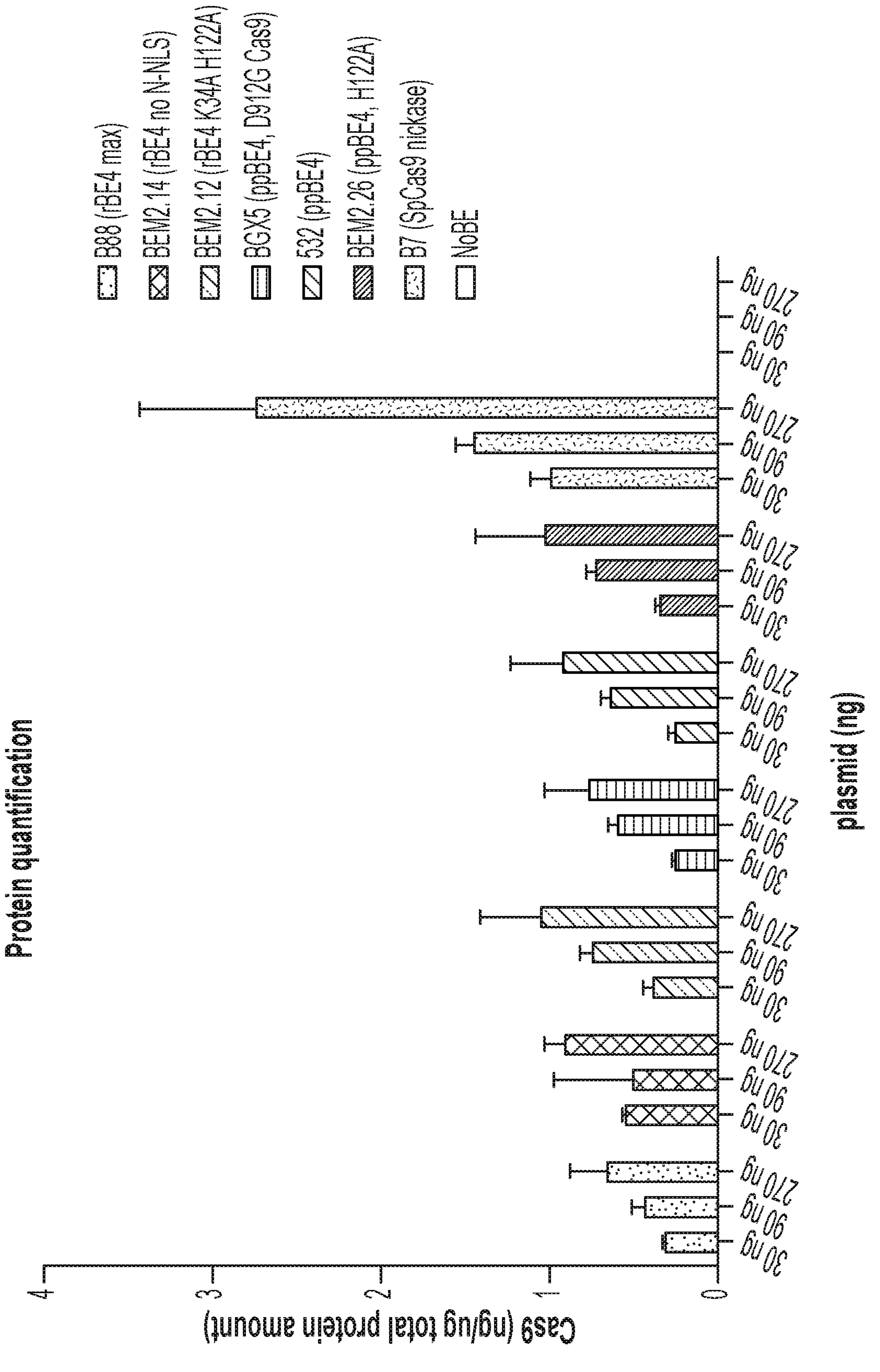

To characterize off-target DNA and RNA editing activities for selected CBEs. From studies on the dose-dependency of base editors, a significant difference on $IC_{50}$ values was identified for in cis activities and in trans activities (FIGS. 10A and 10B). To examine if different protein expression level of editors contributed to changes in cis/trans editing profile, quantification of base editor mRNA and protein was performed on cells transfected with editor plasmids (FIGS. 12A and 12B; Table 15). For the new CBEs identified, the protein expression level was not significantly lower than rBE4. Additionally, HiFi mutations K34A and H122A did not cause significant changes in base editor transcription and translation. As a result, changes in the cis/trans editing profile originates from the intrinsic characteristics of deaminases.

TABLE 15

| | Cas9 (ng/μl) |
|---|---|
| pYY-B7 | 0.210411 |
| ppBE4 | 0.132432 |
| ppBE4 H122A | 0.075303 |
| rBE4 | 0.117837 |
| rBE4 K34A R33A | 0.098516 |
| pYY-BEM3.14 | 0.139799 |
| pYY-BEM3.39 | 0.150363 |
| pYY-BEM3.31 | 0.090732 |

Figure 11:
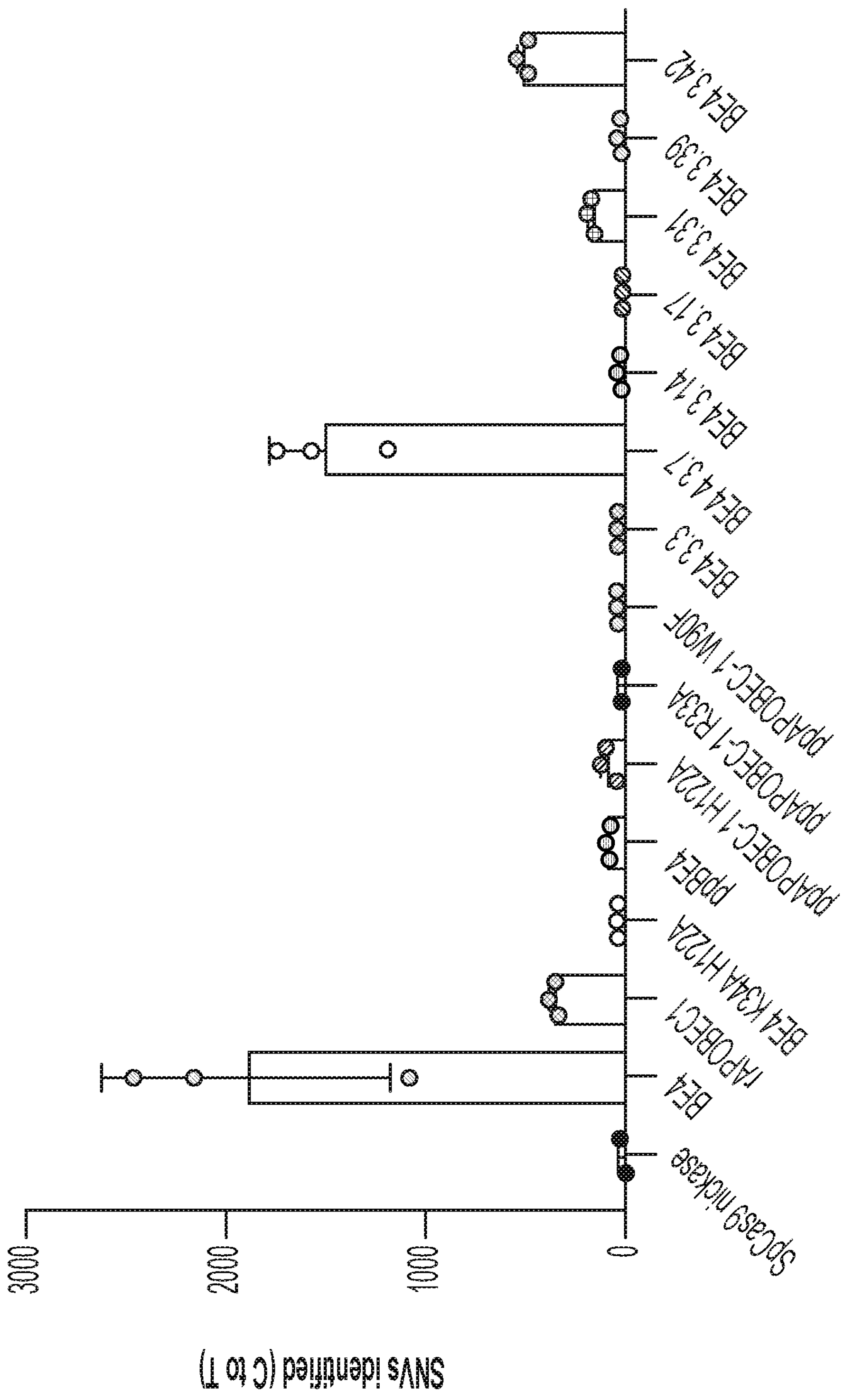
FIG. 11 is a graph depicting off-target editing of selected CBEs. SNVs were identified by exome sequencing.
Figure 13:
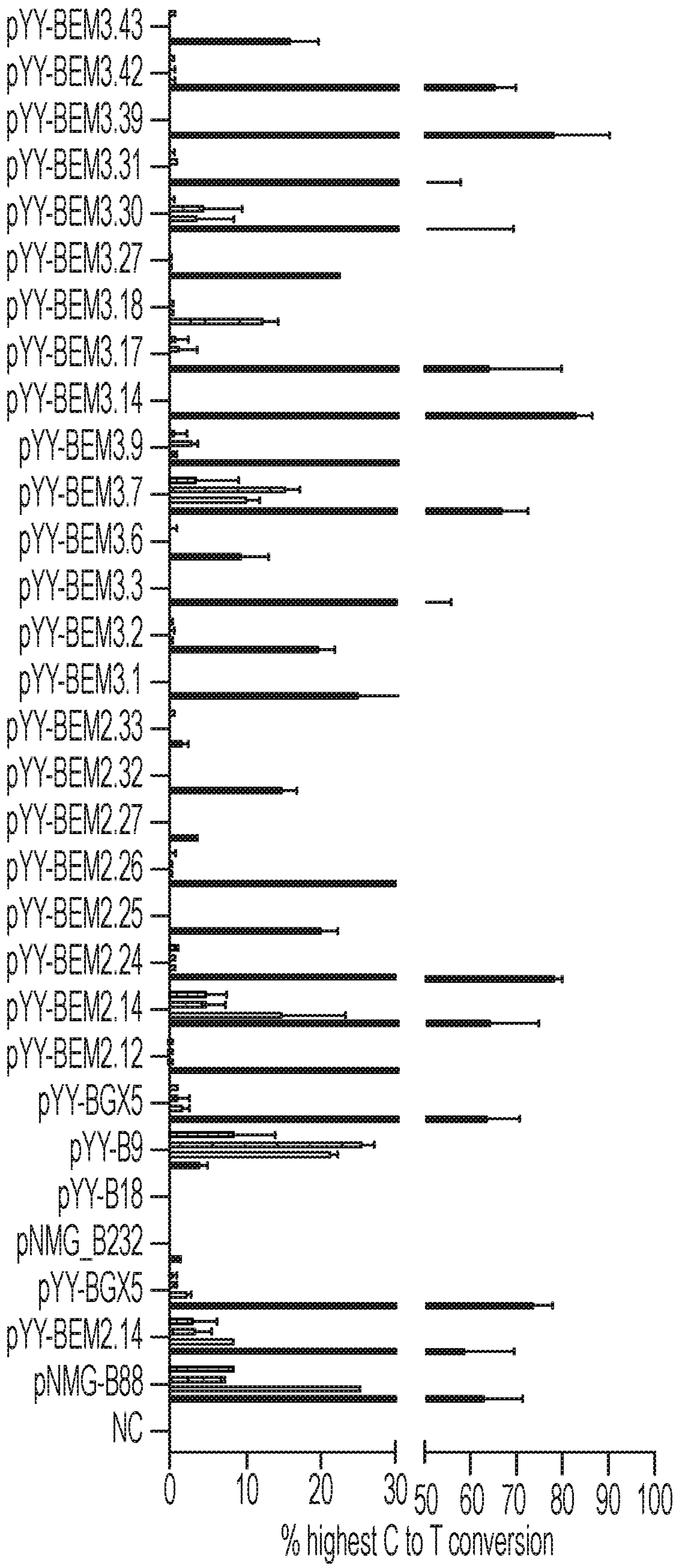
FIG. 13 is a graph depicting targeted RNA sequencing for selected editors. Three regions of 200-300 bp were sequenced.
Figure 14:
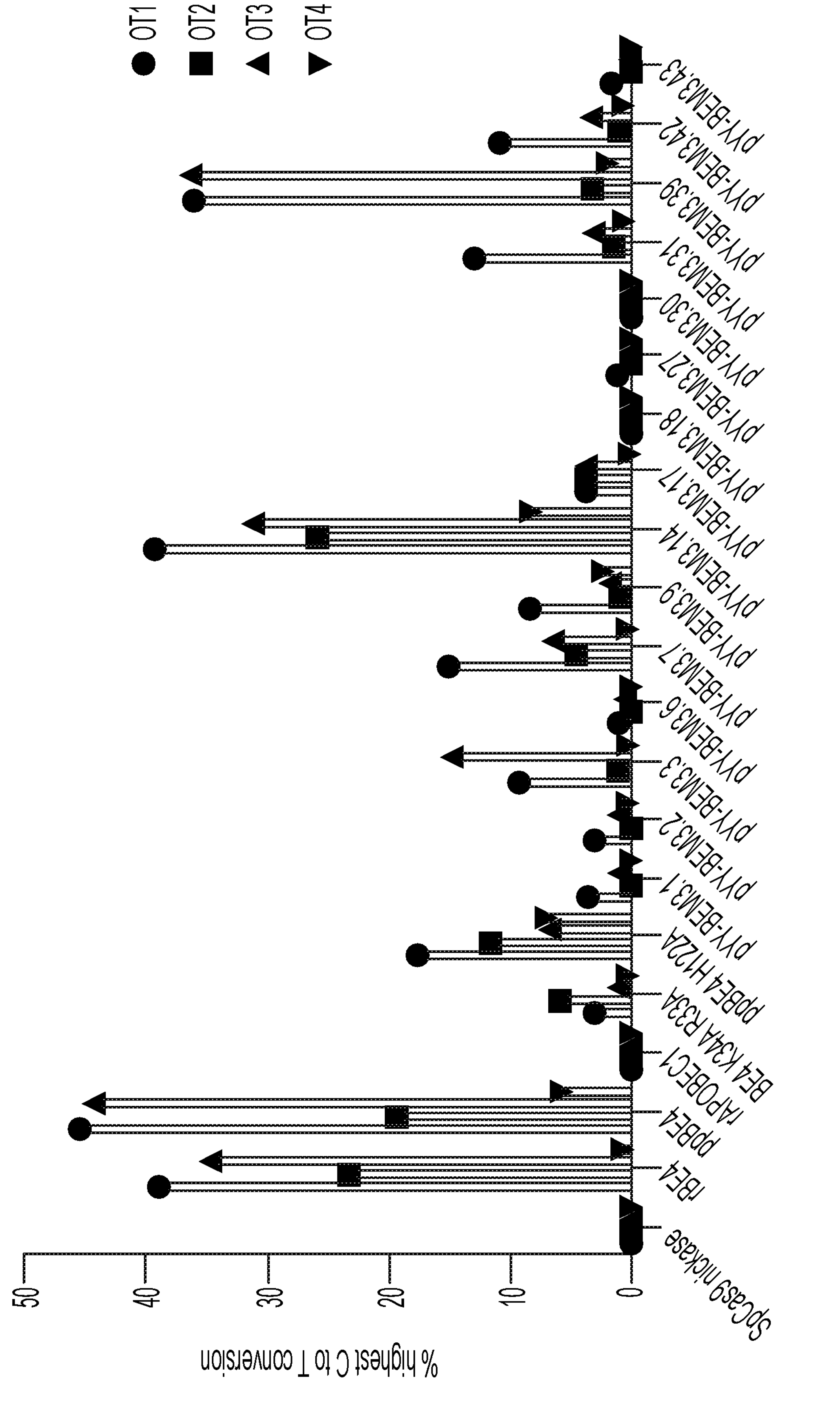
FIG. 14 is a graph depicting guided off-target editing of selected CBEs.
Figure 15B:
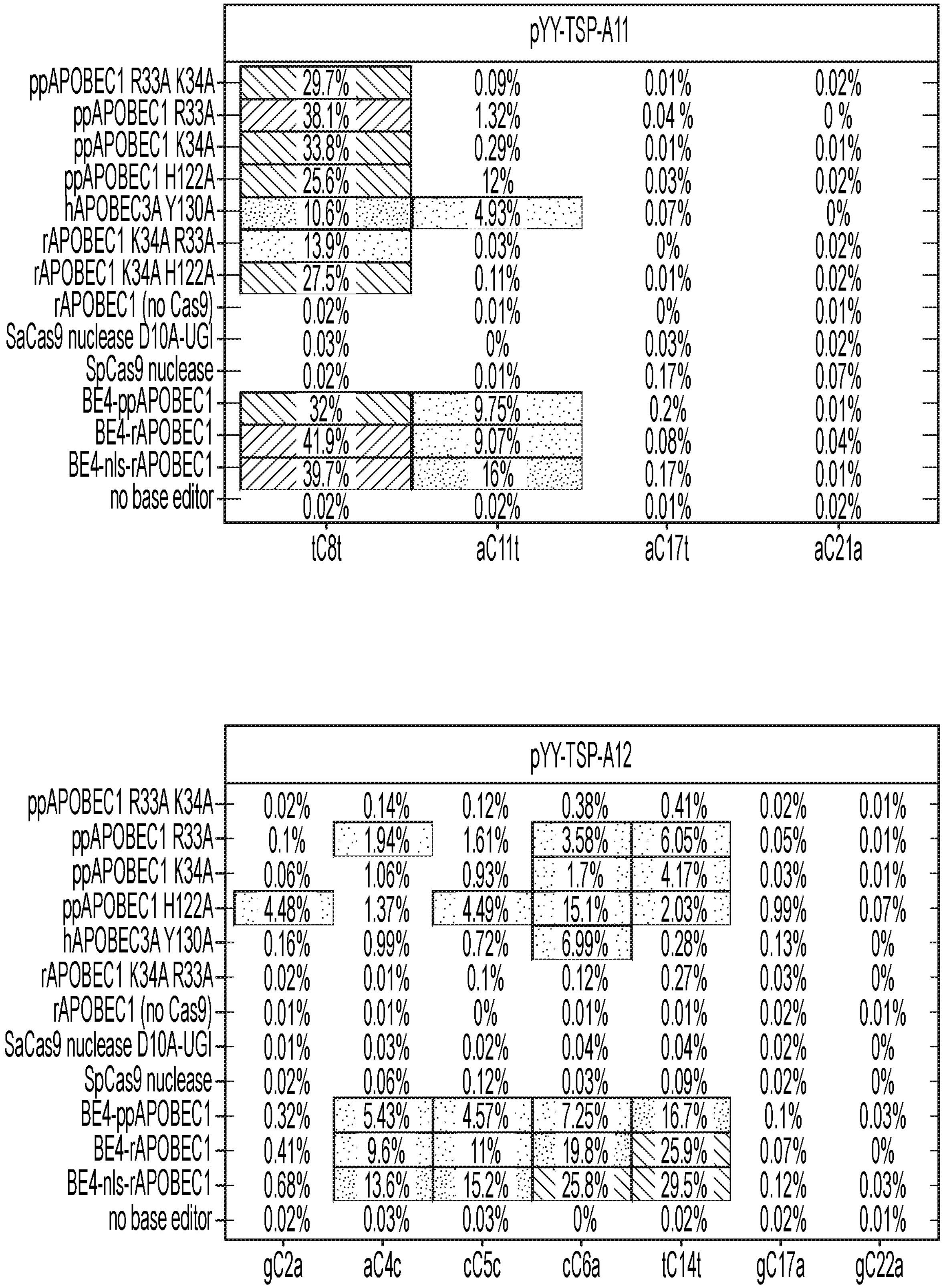
Figure 15C:
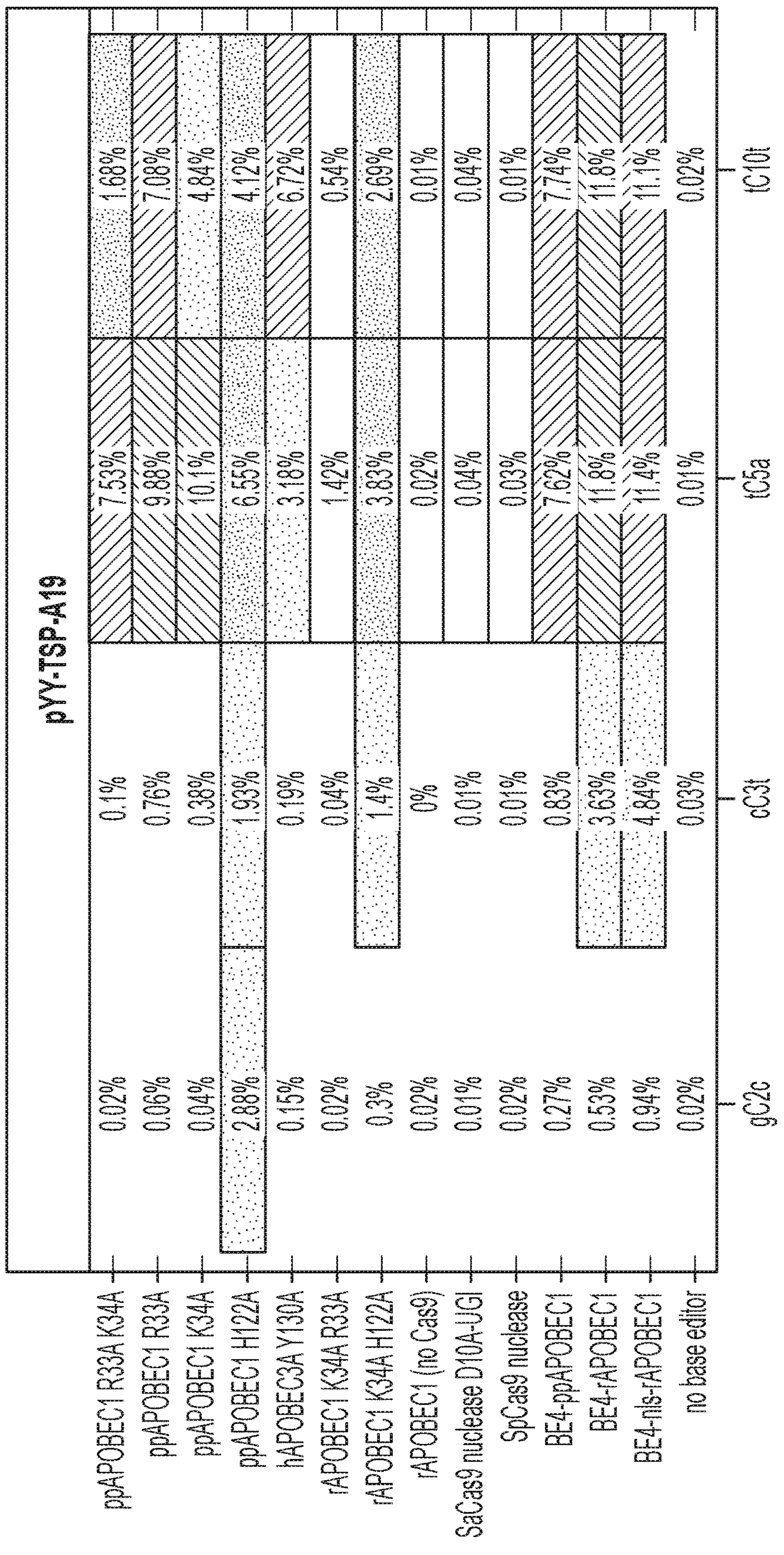
Figure 15C:
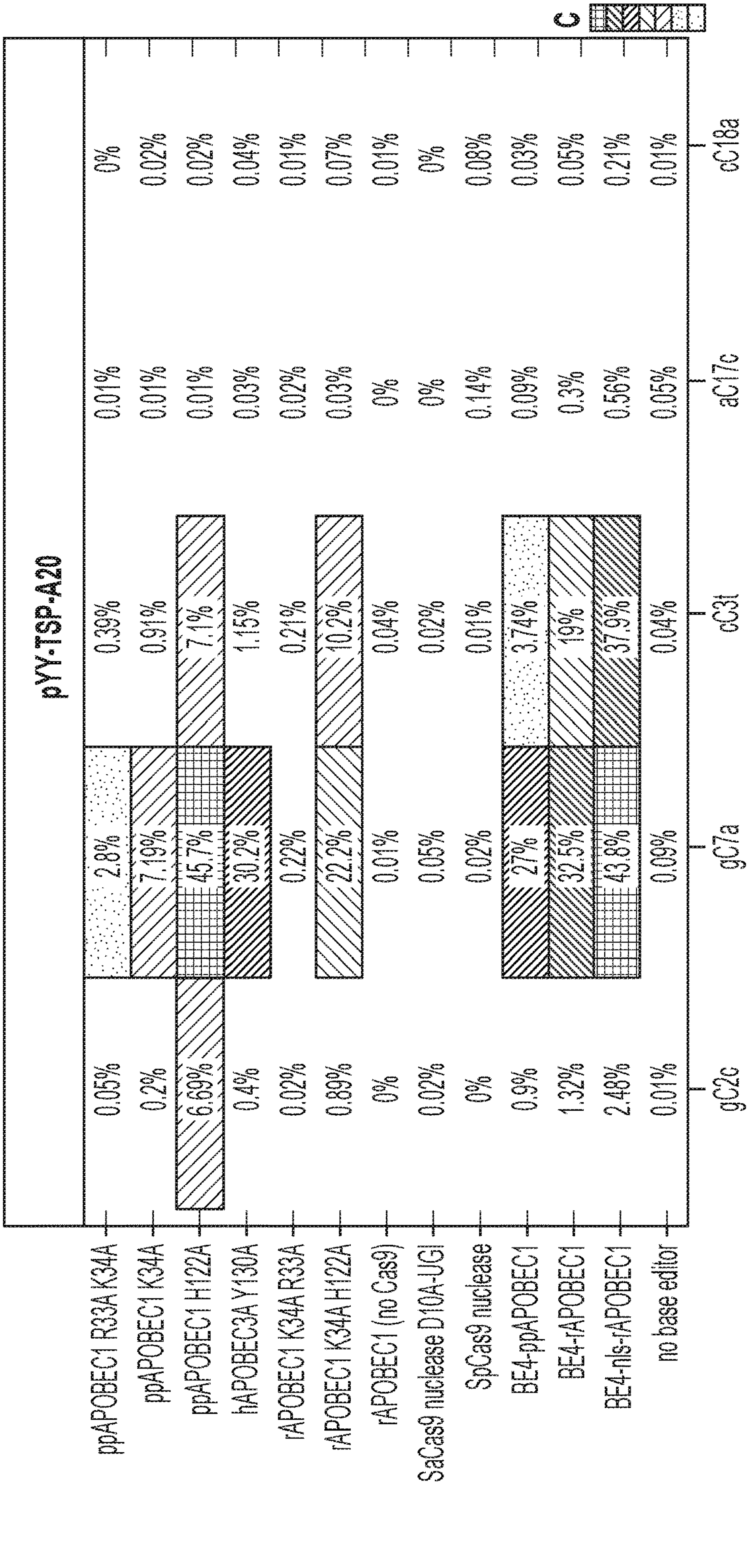
Figure 15D:
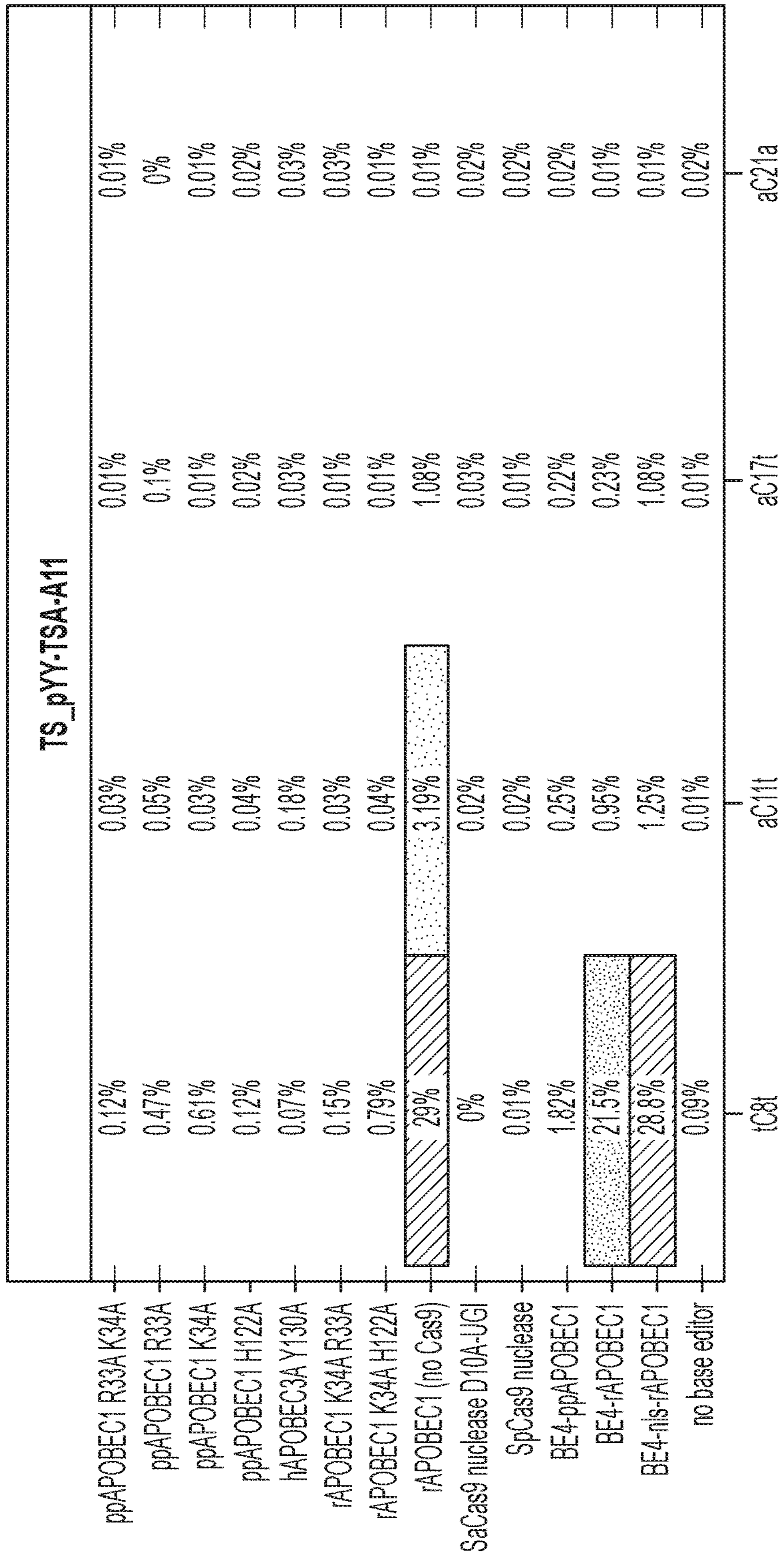

Exome sequencing was performed to evaluate spurious RNA deamination. Interestingly, ppAPOBEC1, RrA3F (BEM3.14), AmAPOBEC1 (BEM3.31) and SsAPOBEC2 (BEM3.39) all showed >20-fold reduction in SNVs that are C to T mutations (FIG. 11). Especially for BEM3.14 and BEM3.39, any spurious RNA deamination was close to background level without additional mutagenesis. Deep sequencing of selected regions in the transcriptome are consistent with exome sequencing data (FIG. 13). DNA off-target editing was examined at predicted Cas9 off-target sites. Guided off-target activities of ppAPOBEC1, BEM3.14, and BEM 3.39 were similar to rAPOBEC1 (FIG. 14). Since the enzymatic mechanism of guided off-target editing is highly similar with on-target editing, it was expected that alternation of deaminases was unlikely to reduce these types of off-target editing. On the other side, less active CBEs or CBEs with HiFi mutations are associated with lower guided off-target editing.

For evaluation of spurious DNA off-target editing, in vitro enzymatic assay on free ssDNA was used in addition to a cis/trans assay to address concerns about the limitation of substrate availability in Cas9 induced R-loop. Cell lysate was incubated with single strand oligos for 30 min at 37° C. After a 30 minute incubation, about 5-fold less edited product was formed with rAPOBEC1 compared to new CBEs (Table 16). This suggests the unusually high activity of rBE4 on ssDNA and supports the necessity to find a replacement for rAPOBEC1 in therapeutic applications.

TABLE 16

| Editor | % C to T editing |
|---|---|
| ppBE4 | 1.793 |
| SpCas9 nickase | 0.116 |
| rBE4 | 8.501 |
| rAPOBEC1 | 13.51 |
| rBE4 H122A, R33A | 1.871 |
| rBE4 | 7.875 |
| ppBE4 H122A | 1.789 |
| pYY-BEM3.1 | 1.805 |
| pYY-BEM3.2 | 1.705 |
| pYY-BEM3.3 | 1.868 |
| pYY-BEM3.6 | 1.748 |
| pYY-BEM3.7 | 1.522 |
| pYY-BEM3.9 | 1.49 |
| pYY-BEM3.14 | 1.932 |
| pYY-BEM3.17 | 1.764 |
| pYY-BEM3.18 | 2.008 |
| pYY-BEM3.27 | 1.666 |
| pYY-BEM3.30 | 1.983 |
| pYY-BEM3.31 | 1.691 |
| pYY-BEM3.39 | 1.553 |
| pYY-BEM3.42 | 1.51 |
| pYY-BEM3.43 | 1.616 |
| pYY-BEM3.36 | 1.8 |

Example 2: Next-Generation Cytosine Base Editors with Minimized Unguided DNA and RNA Off-Target Events and High On-Target Activity Unlike CRISPR-associated nuclease gene approaches, base editors (Bes) do not create double-stranded DNA breaks and therefore minimize the formation of undesired editing byproducts, including insertions, deletions, translocations, and other large-scale chromosomal rearrangements. Cytosine base editors (CBEs) are comprised of a cytosine deaminase fused to an impaired form of Cas9 (D10A), which is tethered to one (BE3) or two (BE4) monomers of uracil glycosylase inhibitor (UGI). This architecture of CBEs enables the conversion of C·G base pairs to T·A base pair in human genomic DNA, through the formation of an uracil intermediate.

Although CBEs lead to robust on-target DNA base editing efficiency in a variety of contexts (e.g., rice, wheat, human cells and bacteria), it has been reported that treatment of cells with high doses of Base Editor 3 (BE3) can lead to low, but detectable, spurious cytosine deamination in both DNA and cellular RNA, which occur in an unguided fashion, independent of the sgRNA sequence used. Specifically, in treatment of rice with BE3, substantial genome-wide spurious C to T SNVs occurred, above background, and enriched in genic regions. Further, in a study in which spurious DNA editing events resulting from microinjection of BE3 in mouse embryos were evaluated, a mutation rate of one in ten million bases was detected. This resulted in approximately 300 additional single nucleotide variants (SNVs) compared to untreated cells. (Zuo, E. et al., *Science,* 364:289-292 (2019)). While this rate of mutation is within the range that occurs naturally in mouse and human somatic cells, this Example described the development of next-generation CBEs that function efficiently at their on-target loci, with minimal off-target spurious deamination relative to the foundational base editors, BE3/4, which contain rAPOBEC1. Such new CBEs are particularly advantageous, given their therapeutic importance.

Since both DNA and RNA off-target deamination events result from unguided, Cas9-independent deamination events, such undesired editing byproducts were likely to be caused by the intrinsic ssDNA binding affinities of the cytosine deaminase itself. The canonical CBE base editor BE3, mentioned supra, contains an N-terminal cytidine deaminase rAPOBEC1, an enzyme that deaminates both DNA and RNA when expressed in mammalian, avian, and bacterial cells. CBEs containing rAPOBEC-1 (e.g., BE3, BE4, BE4-max) are widely utilized base editing tools due to their overall high on-target DNA editing efficiencies; however, existing, and/or engineered deaminases may provide similar high, on-target DNA editing efficiency while preserving a minimized unguided, deaminase dependent, off-target profile.

Example 3: High-Throughput Assay to Evaluate Unguided ssDNA Deamination

Figure 17A:
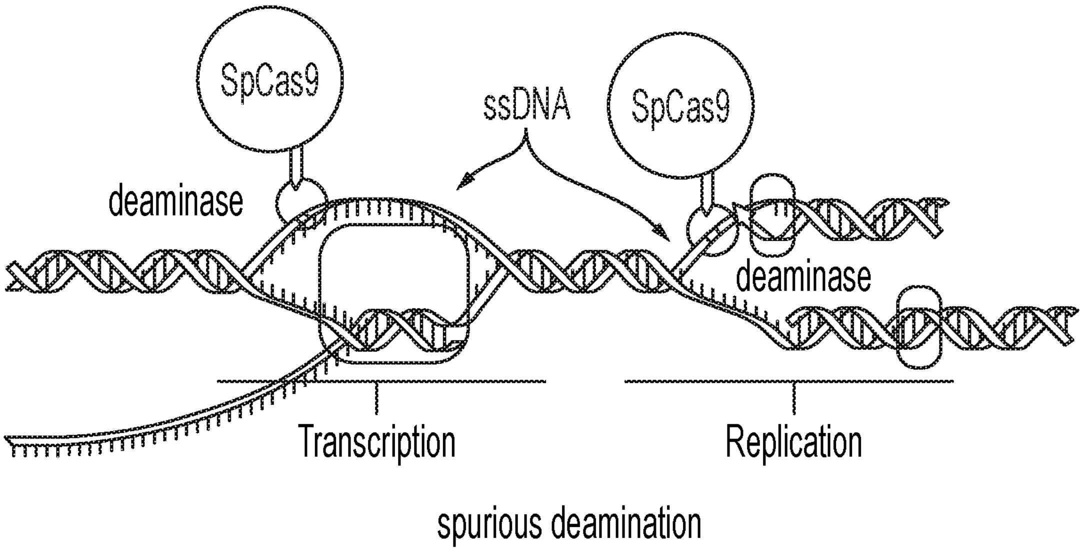
FIGS. 17A-17D show pictorial illustrations and graphs related to unguided ssDNA deamination and in cis/in trans assay.
Figure 17B:
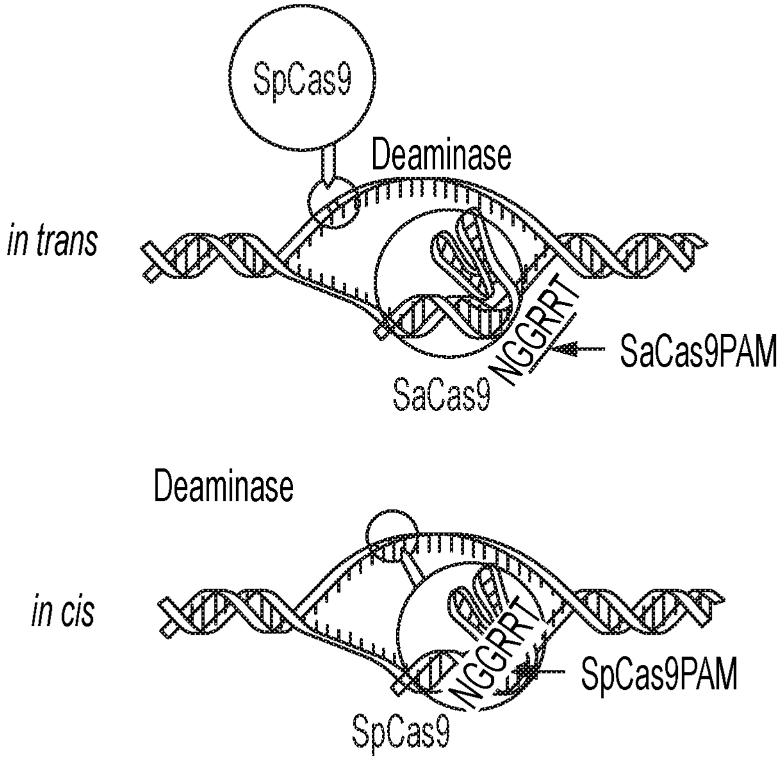

To screen a wide range of next-generation CBE candidates for preferred on- and off-target editing profiles, a high-throughput assay was established to evaluate unguided ssDNA deamination. While not intending to be bound by theory, rAPOBEC1 may be most able to access transiently-available ssDNA that is generated during DNA replication or transcription, especially since spurious deamination in the genome has been reported to occur most frequently in highly transcribed regions of the genome, (FIG. 17A). Therefore, experiments were conducted to mimic the availability of genomic ssDNA by presenting this substrate via a secondary R-loop generated by an orthogonal SaCas9/sgRNA complex. The amount of unguided editing on this ssDNA substrate with fully intact CBEs was quantified. (FIG. 17B). Herein, "in cis" activity refers to on-target DNA base editing, and "in trans" activity refers to base editing in the secondary SaCas9-induced R loop, to which the base editor is not directed by its own sgRNA, thus mimicking the transient, unguided off-targeting editing events in the genome observed in mice and in rice.

Figure 17C:
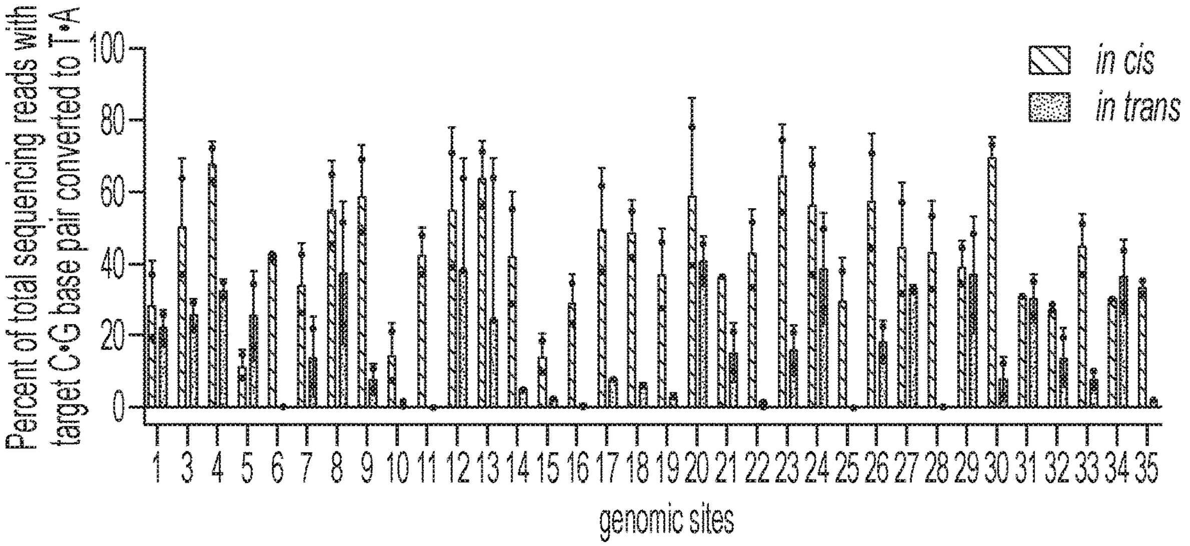
Figure 17D:
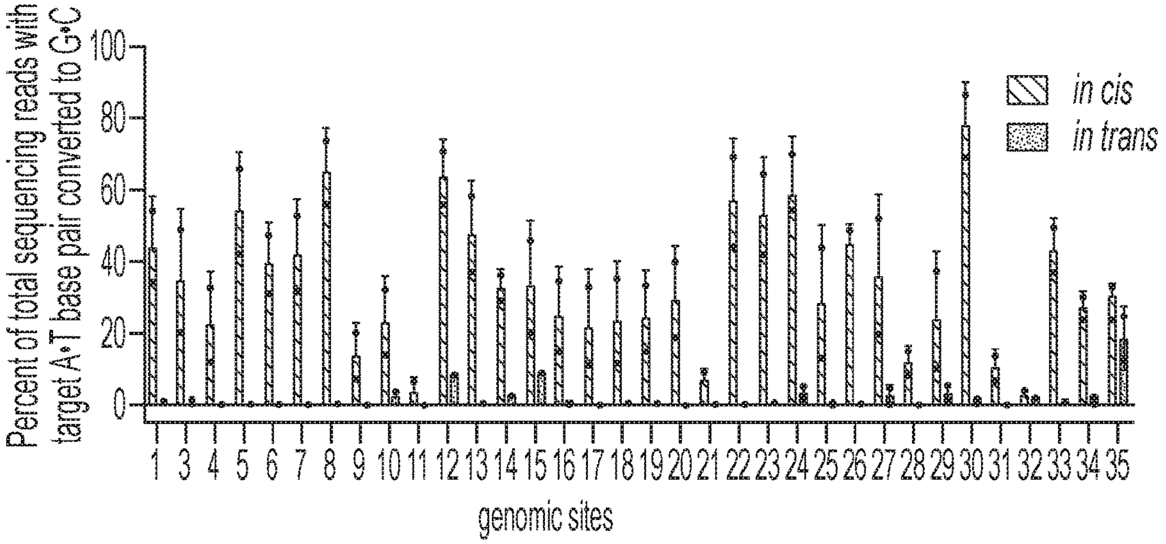
Figure 18:
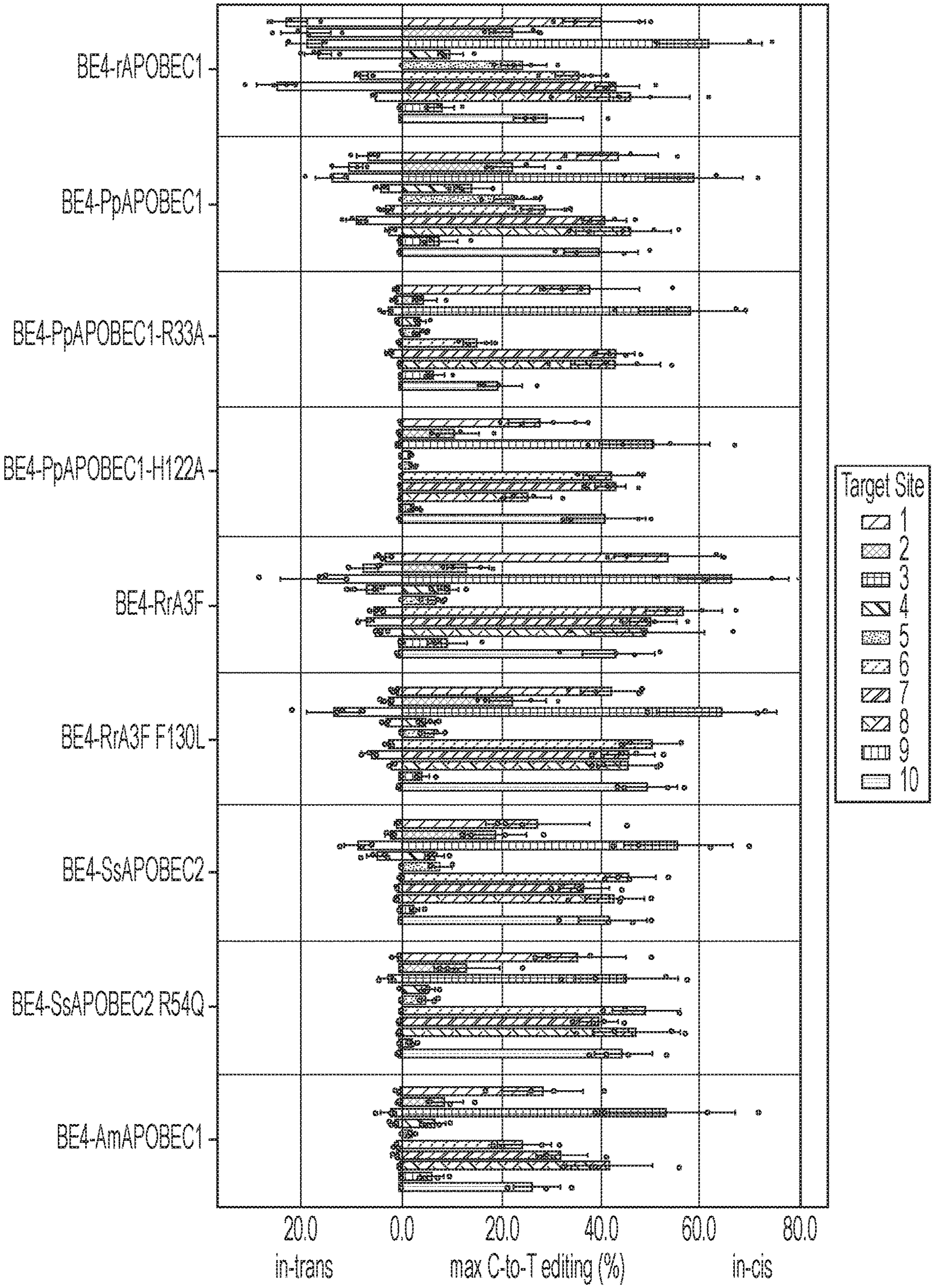
FIG. 18 presents a bar graph showing identified next generation CBEs with high in cis activities and reduced in trans activities compared to BE4 with rAPOBEC1. Shown is a comparison of in cis and in trans editing frequencies of mammalian cells treated with next generation CBEs (BE4 with PpAPOBEC1 [wt, H122], RrA3F [wt, F130L], AmAPOBEC1, SsAPOBEC2 [wt, R54Q] at 10 genomic sites. Base editing efficiencies were reported for the most edited base in the target sites. Values and error bars reflect the mean and s.d. of 4 independent biological replicates.

The validity and sensitivity of this on- and off-target editing evaluation assay was assessed using cells treated with the base editors BE4 and ABE7.10 ("BE4 and ABE7.10 treated cells"). It has been reported that cells treated with BE3 (CBE with rAPOBEC-1), but not ABE7.10, display an increase in unguided, spurious deamination in genomic DNA. Consistent with these findings, the assay described herein also showed that cells treated with BE4 (with rAPOBEC1) led to much greater levels of in trans editing than those treated with ABE7.10 (FIG. 17C and FIG. 17D). The sensitivity of the assay is demonstrated by the result that treatment of cells with an ABE7.10 variant led to >0.5% A-to-G editing at 16 of 34 loci tested in trans, up to a maximum of 19% (FIG. 17D). While not wishing to be bound by theory, the sensitivity of this assay as described herein may be attributed to the presentation of the ssDNA substrate via a stable R-loop generated by catalytically impaired Sa-Cas9 nickase with two UGI protomers attached (Sa-Cas9(D10A)-UGI-UGI) and to the measurement of deamination events by Illumina amplicon sequence with at least 5,000 reads per sample.

Figure 20:
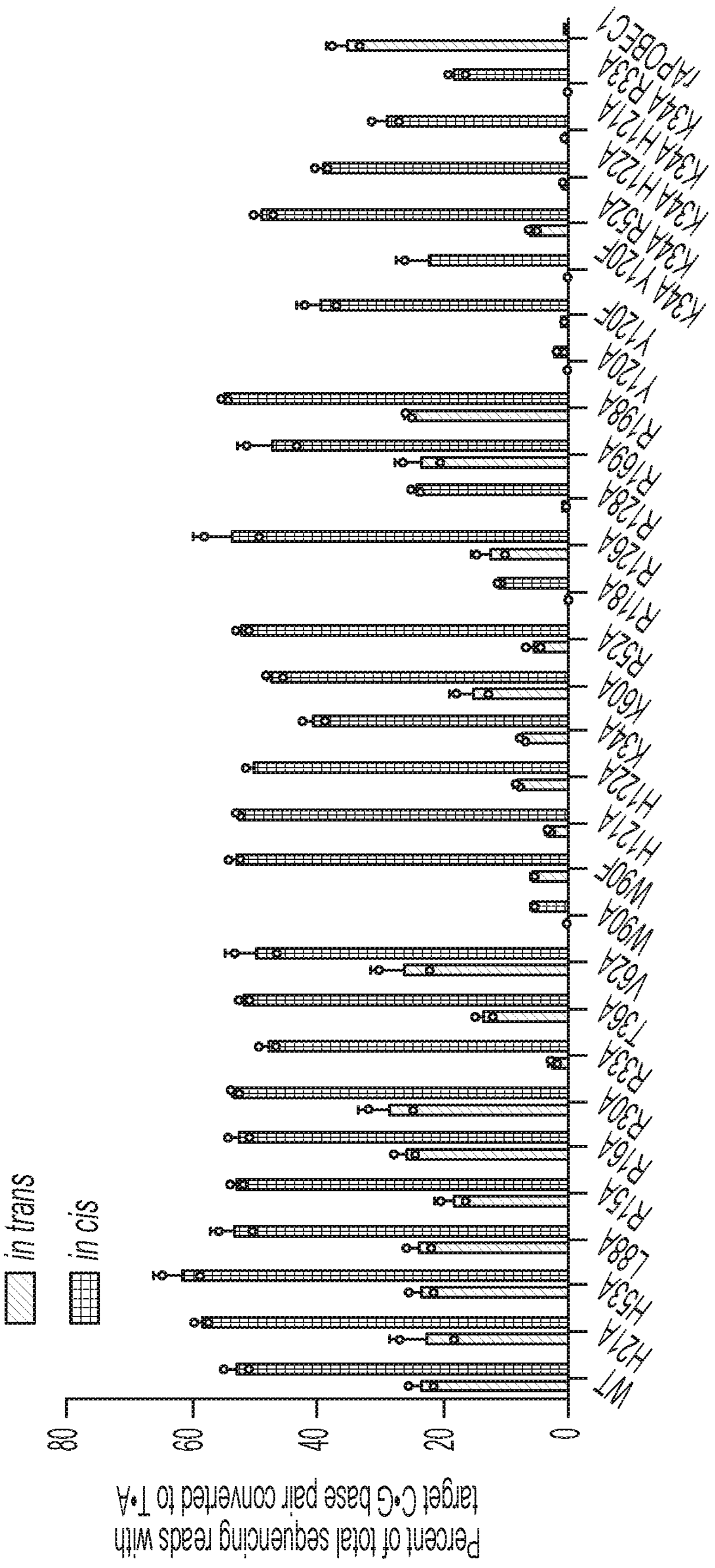
FIG. 20 graphically depicts in cis/in trans editing activities of BE4 with rAPOBEC1 mutants shown in FIGS. 4A and 4B at site 1. Base editing efficiencies were reported for the most edited base in the target sites. In trans efficiency is indicated by the leftmost for each target site on the x-axis; in cis efficiency is indicated by the right bars for each target sit on the x-axis. Values and error bars reflect the mean and s.d. of independent biological duplicates.
Figure 21:
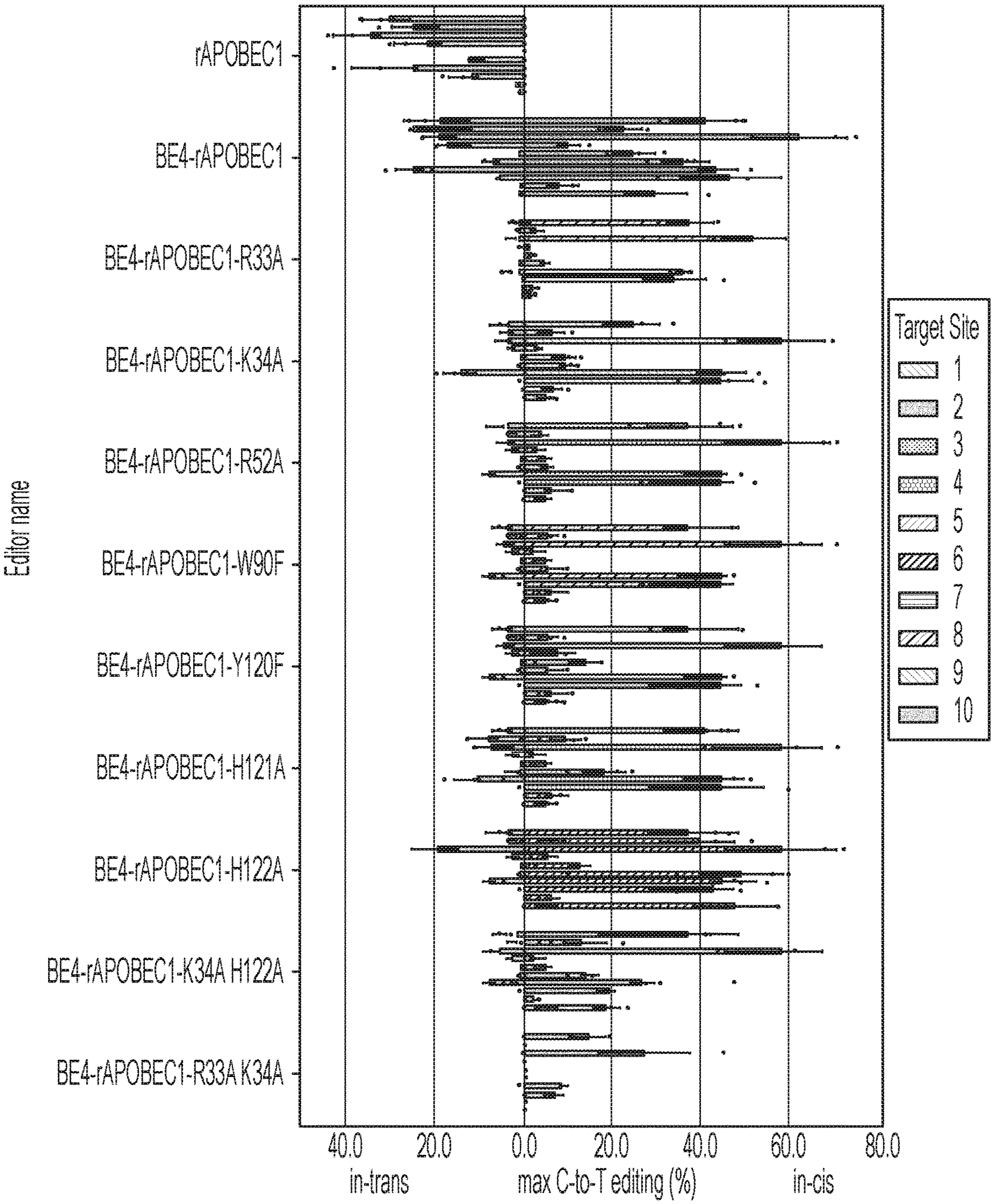
FIG. 21 depicts in cis/in trans editing activities of BE4-rAPOBEC1 with HiFi mutations at 10 target sites. Values and error bars reflect the mean and s.d. of four independent biological replicates.

This cellular assay was first used to test if mutagenesis of deaminases was able to be used to reduce in trans activity, which has been shown to be a means of reducing RNA off-target editing and bystander editing. Utilizing a homology model of rAPOBEC1 (FIG. 4A and FIG. 4B), 15 residues predicted to be important for ssDNA binding and 8 that affected catalytic activity (23 total residues) were identified based on hA3C crystal structure. Through mutagenesis of these 23 residues, 7 high-fidelity (HiFi) mutations (i.e., R33A, W90F, K34A, R52A, H122A, H121A, Y120F) that reduced in trans activity were identified. However, BE4 (containing rAPOBEC1) with single or double HiFi mutations led to either retention of some in trans activity or dramatically reduced in cis activity in cells (FIG. 20 and FIG. 21).

Example 4: Screening to Identify Next-Generation CBEs

Screening was performed to survey alternative cytidine deaminases that could be used for cytosine base editing.

Figure 22A:
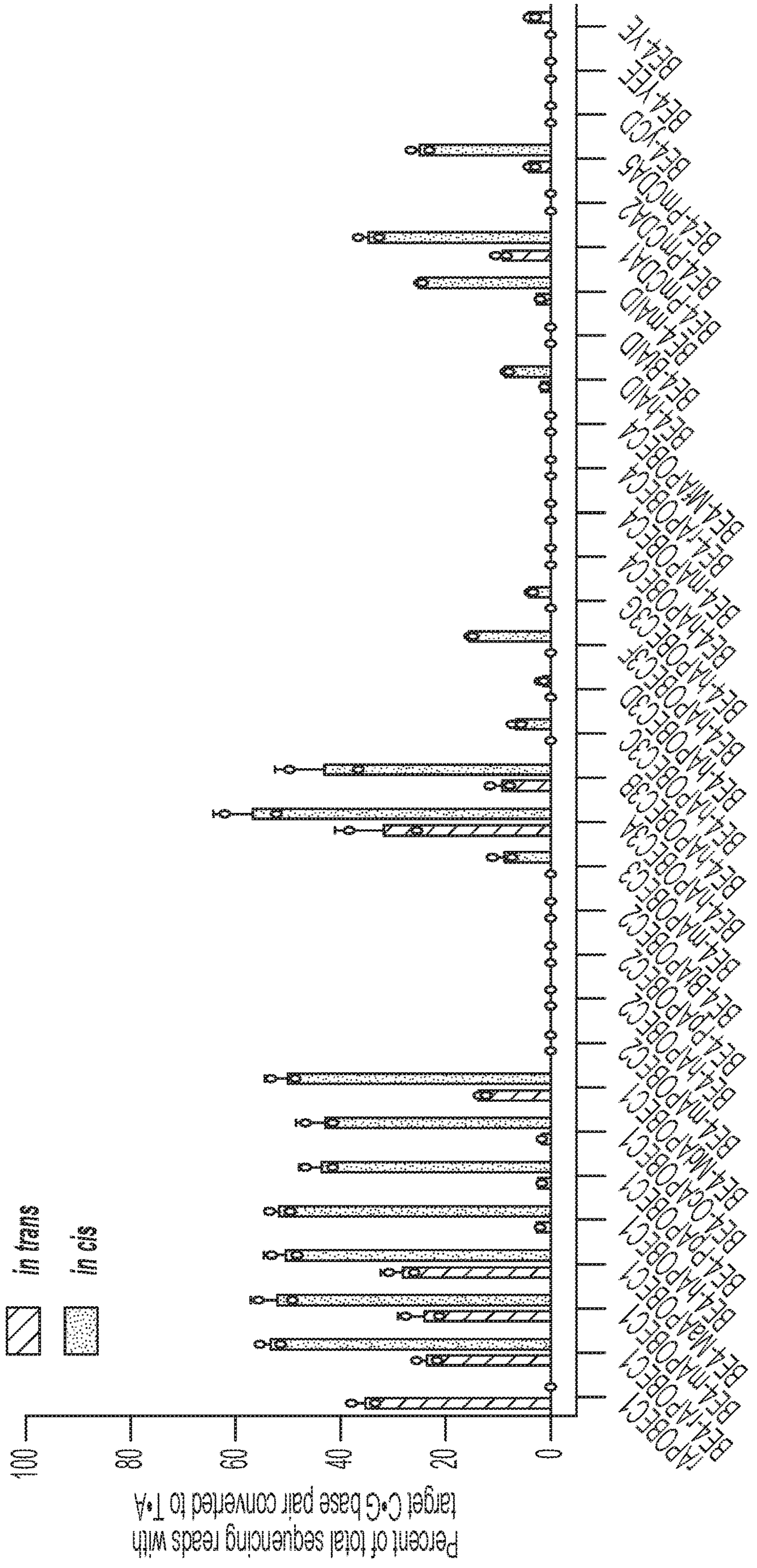
Figure 23:
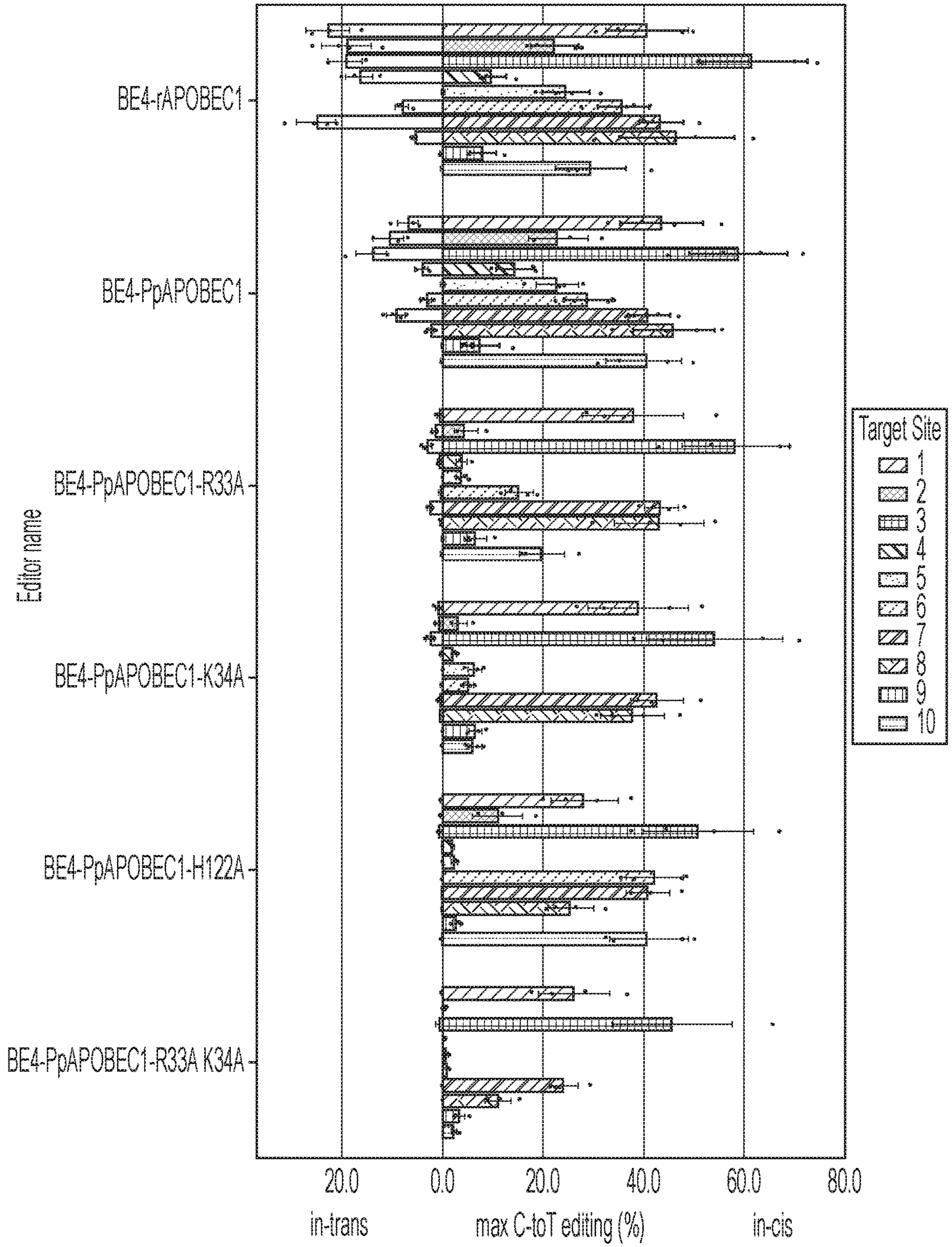
FIG. 23 demonstrates the in cis/in trans activities of BE4-PpAPOBEC1 and BE4-PpAPOBEC with HiFi mutations at 10 target sites. Base editing efficiencies were reported for the most edited base in the target sites. Values and error bars reflect the mean and s.d. of four independent biological replicates.

A preliminary screen of CBEs containing cytidine deaminases from well-characterized families, including APOBEC1, APOBEC2, APOBEC3, APOBEC4, AID, CDA, etc., was first used to search for and identify next-generation CBEs. Three APOBEC1s (i.e., hAPOBEC1, PpAPOBEC1, MdAPOBEC1) showed a high in cis/in trans ratio at select sites (FIG. 22A). Of note, primary sequence alignment of the examined APOBEBC1s with rAPOBEC1 revealed a common phenylalanine substitution at position 120 (FIG. 22B), a mutation identified by preforming a structure-guided mutagenesis (Y120 in rAPOBEC1). Conversely, BE4 constructs containing deaminases which yield high in trans activity (i.e., rAPOBEC1, mAPOBEC1, maAPOBEC1, hA3A) all contained tyrosine at this position (FIG. 22B). This observation supports the predicted function of HiFi mutations and may explain the different behavior of these two groups of cytidine deaminases. BE4 variants containing PpAPOBEC1 deaminase (68% sequence identify as rAPOBEC1) showed on-target DNA activity comparable to BE4 and a 2.3-fold decrease in in trans activity (FIG. 23). BE4 with PpAPOBEC1 containing either H122A or R33A mutations also displayed desirable editing profiles (FIG. 23), with 0.75× and 0.74× average in cis activities and 33 and 13-fold reduction in average in trans activities compared to the respective activities of BE4 with rAPOBEC1. Thus, BE4 with PpAPOBEC1 was identified as a preferred CBE candidate from the first round of screening.

Figure 24:
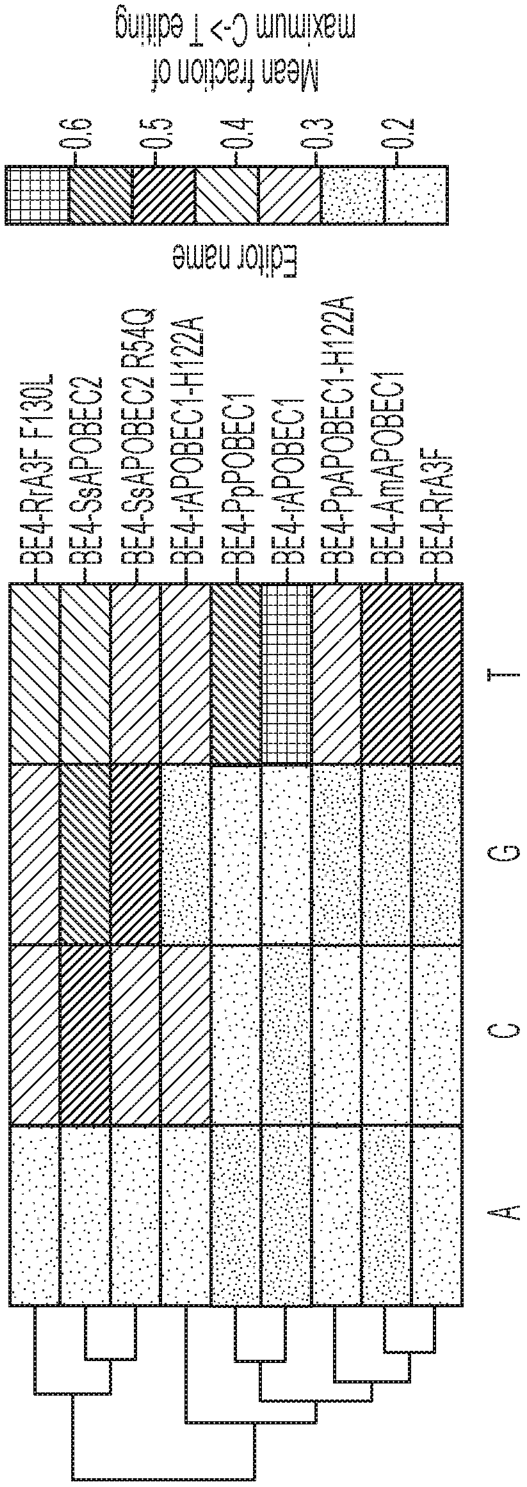
FIG. 24 shows a heatmap indicating prior base preference of CBEs shown in FIG. 18B. Values used to generate the heatmap reflect the mean of four independent biological duplicates.
Figure 26:
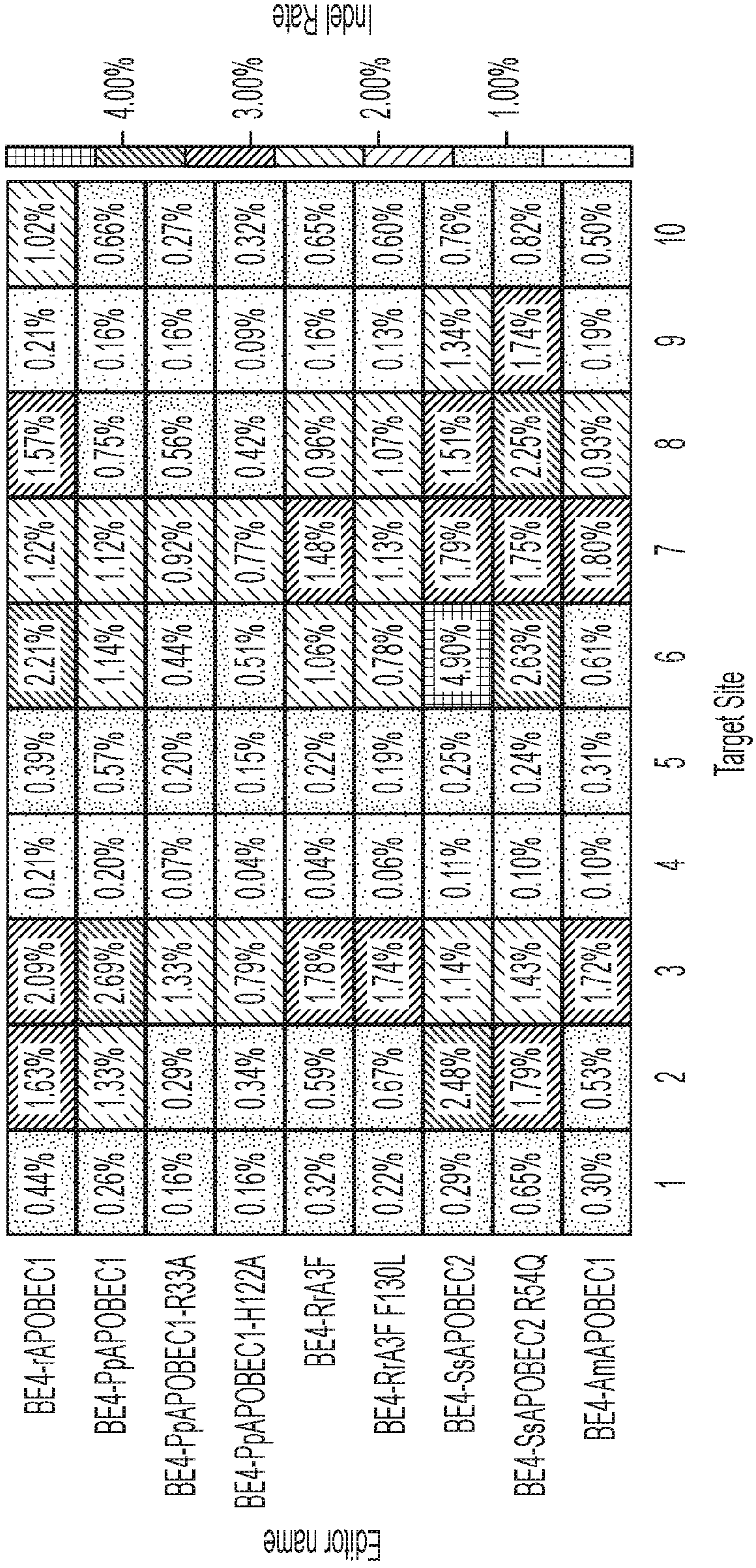
FIG. 26 presents a table showing indel rates of CBEs shown in FIG. 18B at 10 target sites. Values used to generate the heatmap reflect the mean of four independent biological duplicates.
Figure 27A:
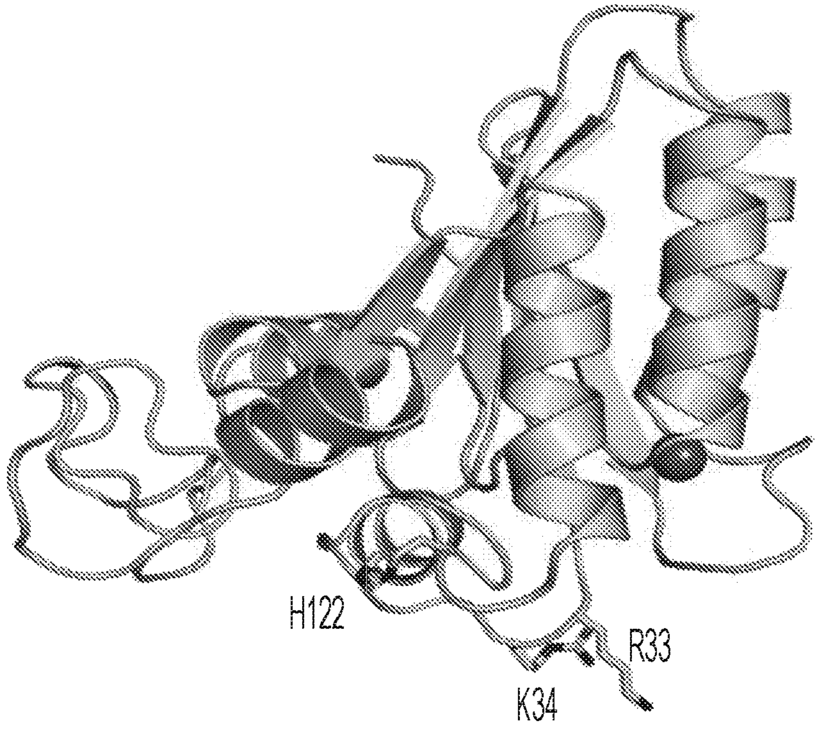
FIGS. 27A-27D depict homology models of four cytidine deaminases selected based on existing crystal structures.
Figure 27B:
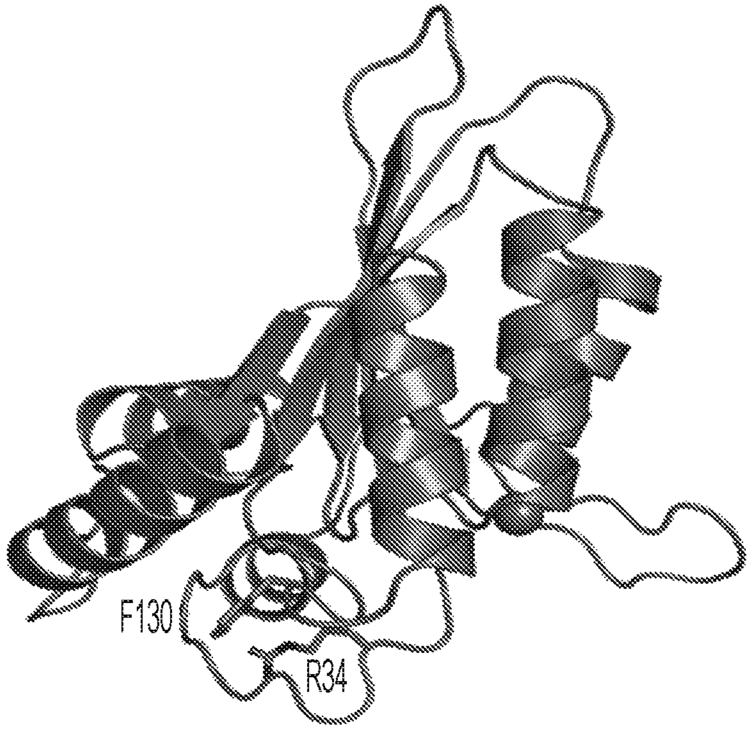
Figure 27C:
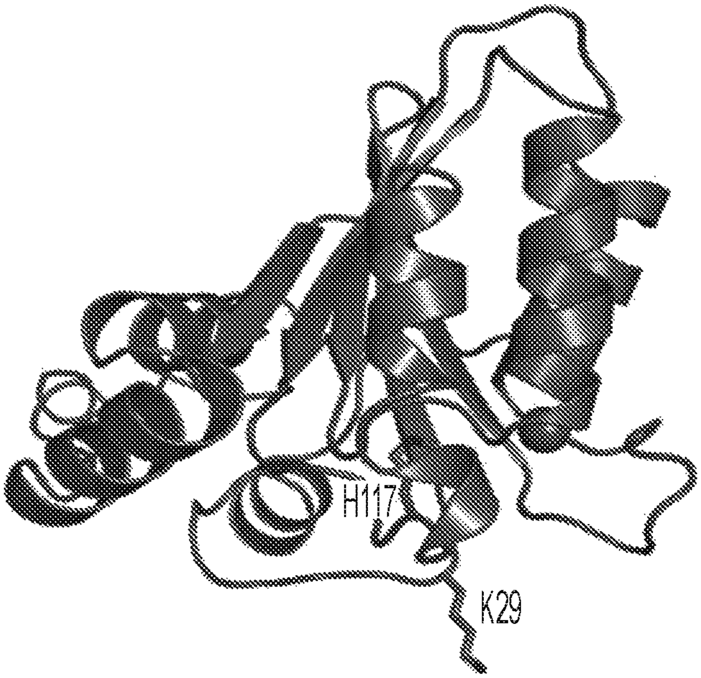
Figure 27D:
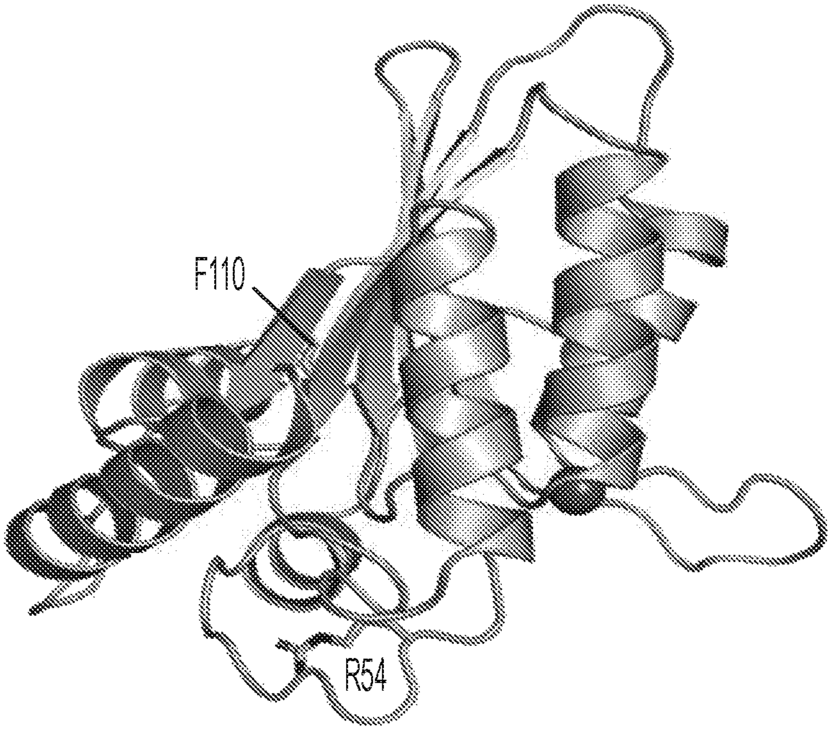
Figure 28A:
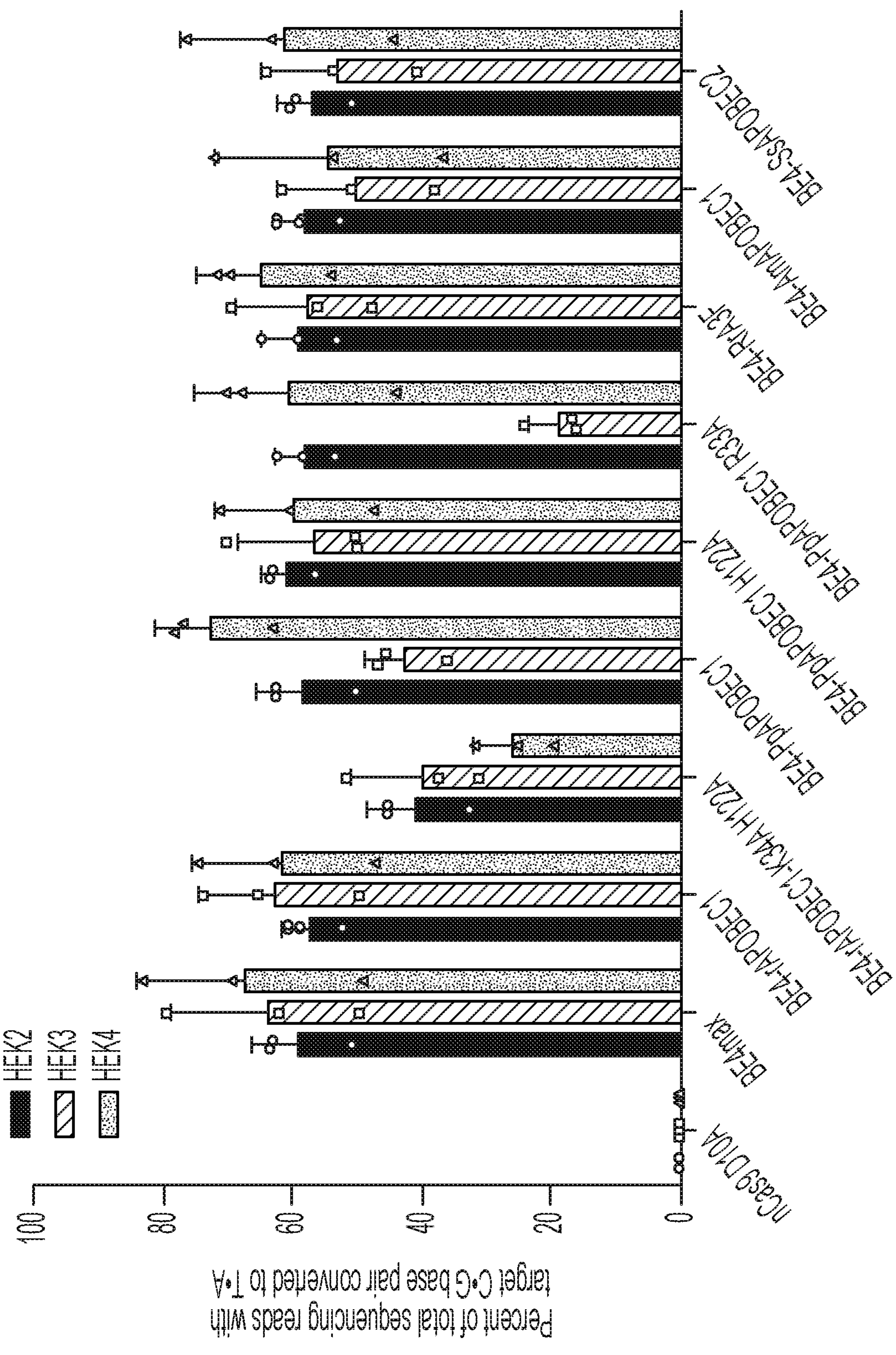
FIGS. 28A-28D present graphs illustrating guided off-target editing of selected next generation CBEs.
Figure 28B:
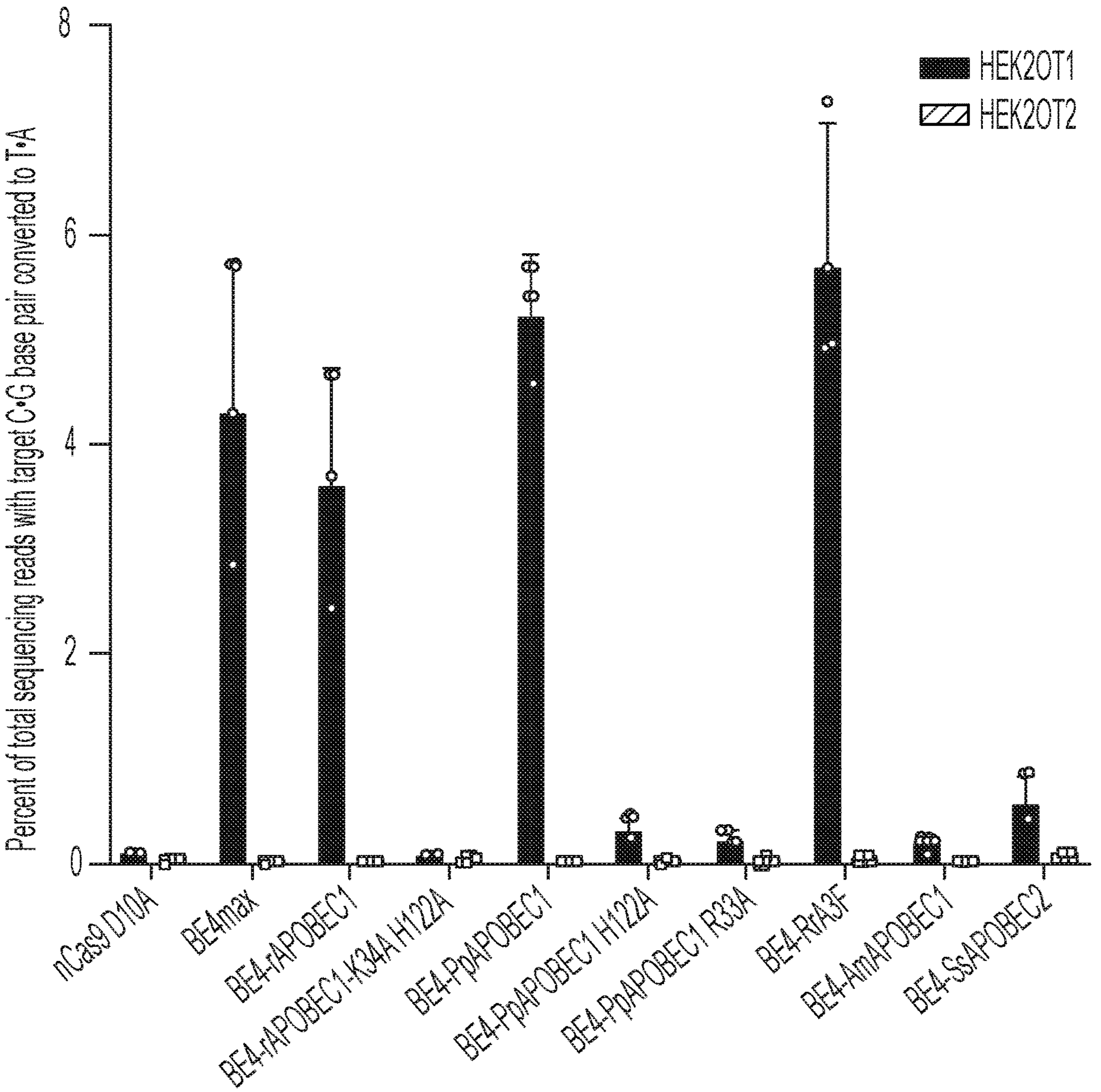
Figure 28C:
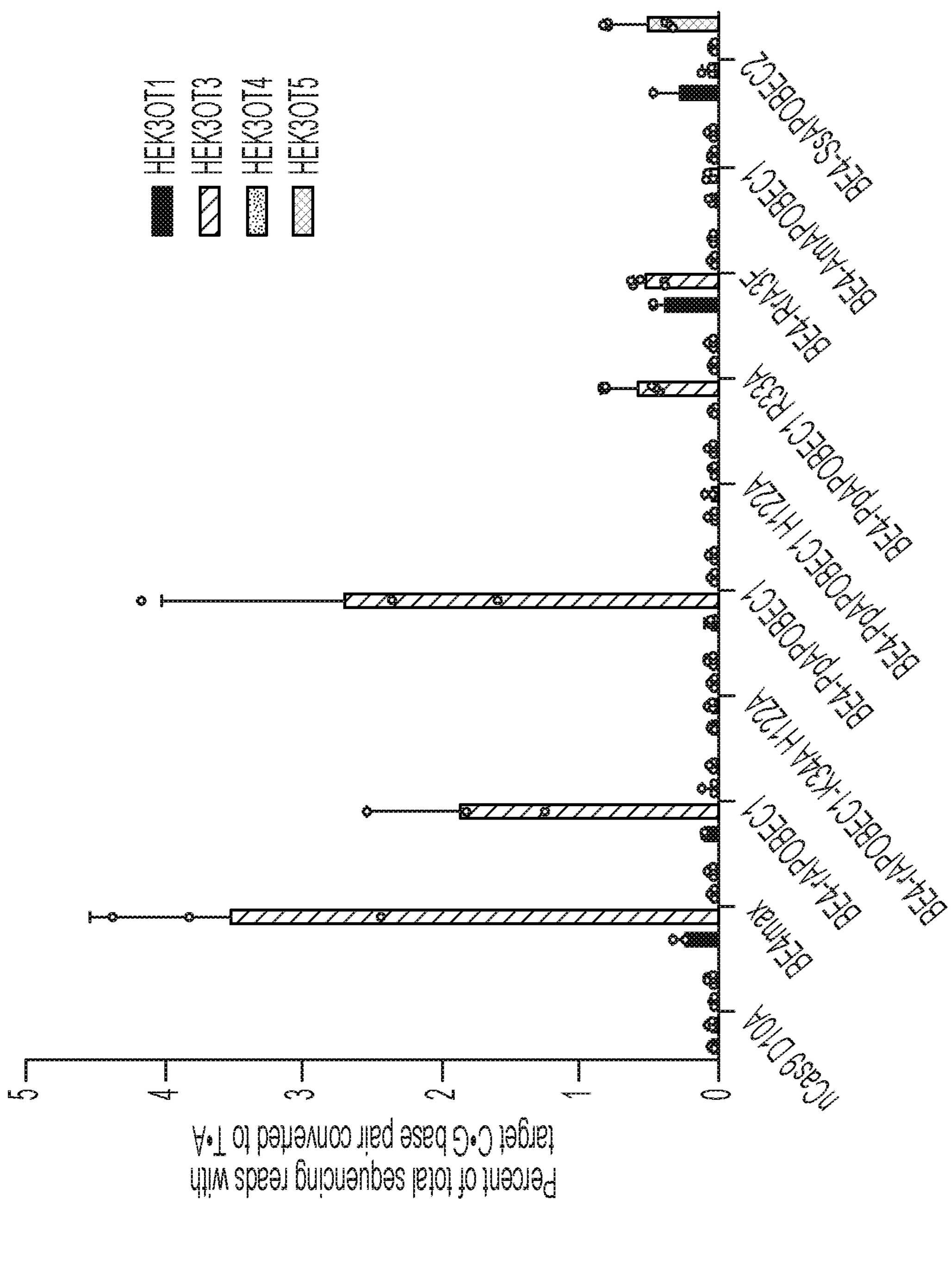
Figure 28D:
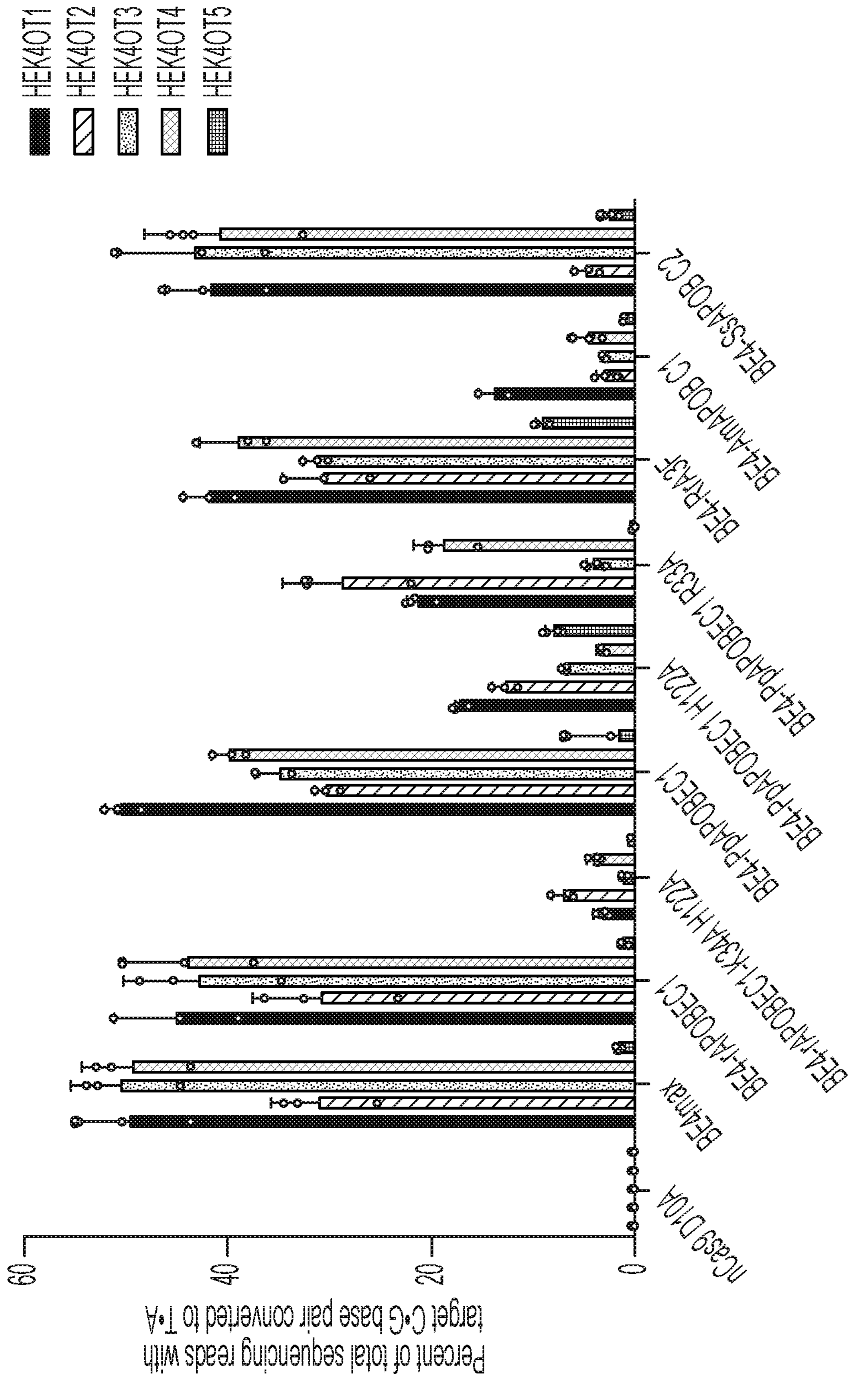

Thereafter, an exhaustive screen of 43 APOBEC-like cytidine deaminases with broad sequence diversity was performed (FIG. 2C). A protein BLAST was carried out with hAPOBEC1 as the query sequence to generate a sequence similarity network (SSN) with the top 1000 sequences, enabling the selection of cytosine deaminases with broad sequence diversity. From this screening campaign, three constructs (i.e., BE4s with RrA3F, AmAPOBEC1, or SsAPOBEC2) showed robust on-target DNA editing activities that were comparable to BE4 (with rAPOBEC1), with 1.05×, 0.71×, and 0.91× average in cis activities, respectively, and 2.3, 13.5, and 6.1-fold decrease in average in trans activity, respectively (FIG. 18 and FIG. 24, FIG. 25 and FIG. 26). Notably, BE4 constructs with either RrA3F or SsAPOBEC2 displayed comparably higher editing frequencies at GC target sites that are not well edited with BE4 (with rAPOBEC1) (FIG. 24). In addition, variations in editing windows of in cis and in trans editing with these editors was observed (FIG. 25). Finally, the screen was again expanded to interrogate a new set of 80 putative cytidine deaminases from other protein families; however, none of these deaminases showed >0.5% editing efficiency in the context of BE4 at the site tested.

The BE4 editors were further optimized (with RrA3F, AmAPOBEC1, or SsAPOBEC2) by rational mutagenesis. (FIG. 20 and FIG. 21). Rationally designed HiFi mutations were installed from the rAPOBEC1 studies (FIGS. 27A-27D) into these four BE4 editors. Two mutants (RrA3F F130L and SsAPOBEC2 R54Q) showed further improved editing profiles (FIG. 18 and FIGS. 25 and 26), with 1.03× and 0.90× average in cis activities and 3.8 and 19.2-fold decrease in average to in trans activities, respectively, relative to the activities of BE4 containing rAPOBEC1. Based on these studies and results, these engineered, alternative deaminase BE4 constructs offer high in cis with reduced in trans editing activity.

Example 5: Evaluation of Off-Target Editing of BE4 Editors

Figure 19A:
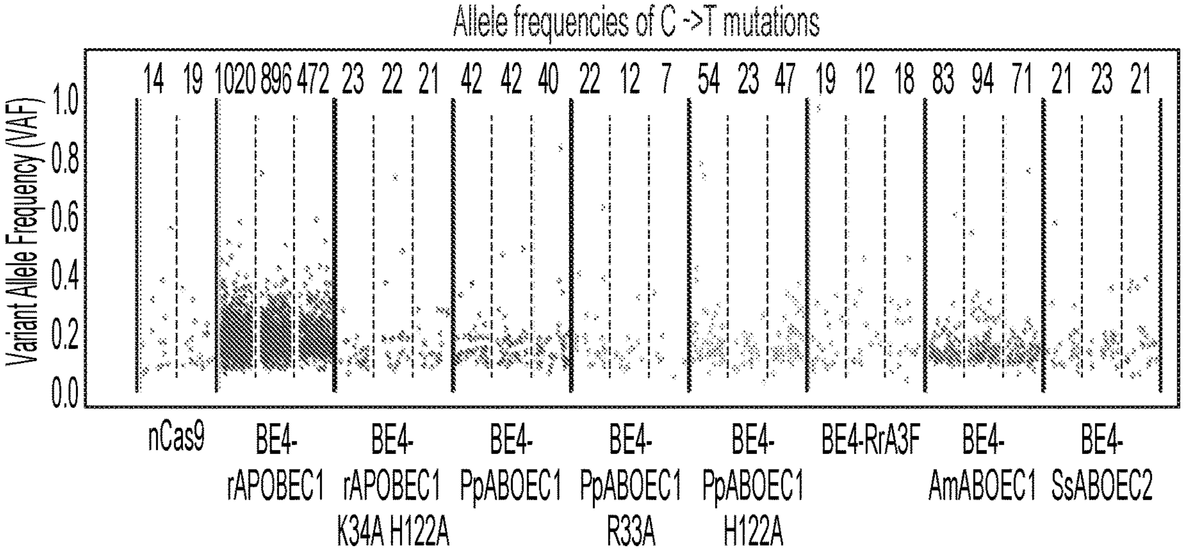
FIGS. 19A-19E show allele frequencies and graphs related to next-generation CBEs with reduced DNA and RNA off-target editing relative to BE4 in mammalian cells.
Figure 19B:
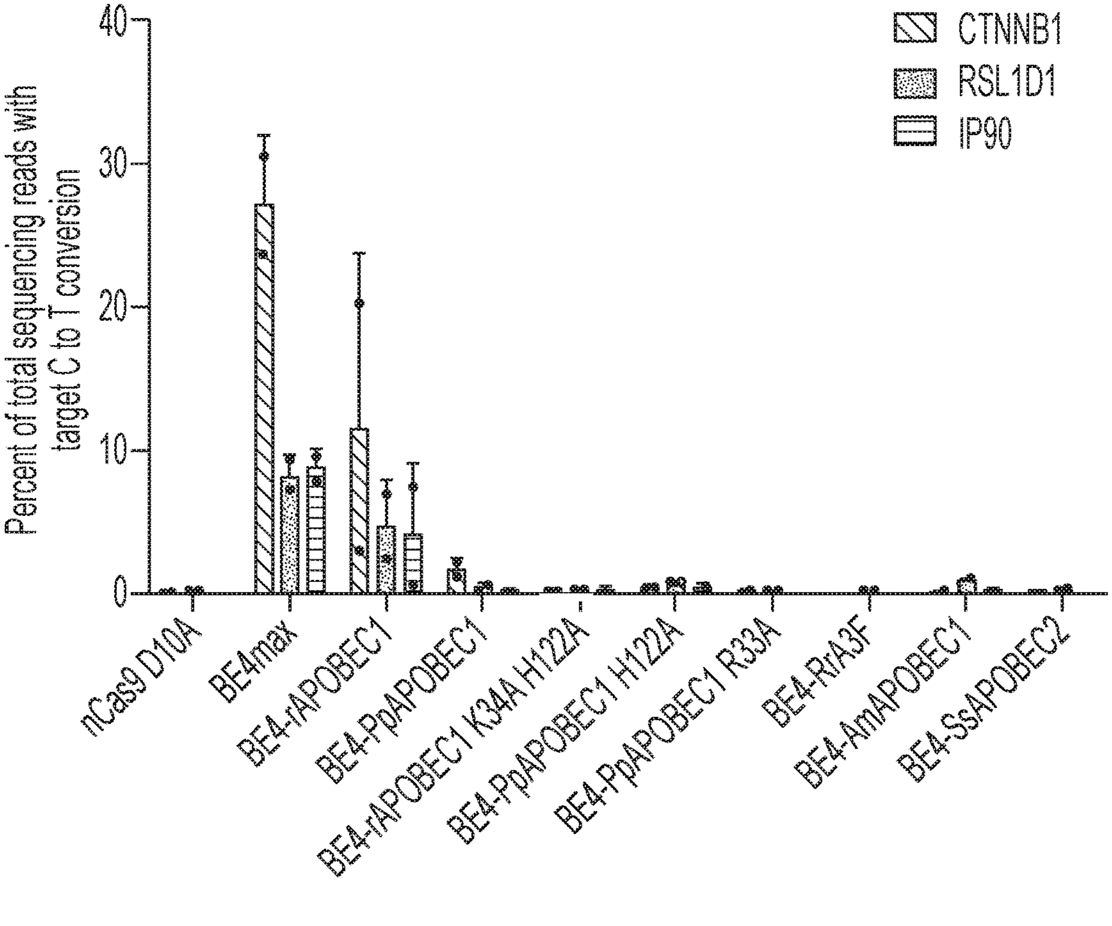

With the described next-generation CBEs in hand, a sub-set [i.e., BE4 with PpAPOBEC1 (wt, H122A or R33A), RrA3F (wt), AmAPOBEC1 (wt), SsAPOBEC2 (wt)] was evaluated to further characterize their off-target RNA activity. It has been reported that plasmid-based overexpression of BE3 containing rAPOBEC1, induced "extensive transcriptome-wide RNA cytosine deamination" (Grunewald, J. et al., *Nature,* 569:433-437 (2019)). In view of this finding, the next-generation CBEs described herein were evaluated in a similar assay (Ibid.). Advantageously, all six next-generation BE4s tested showed >20-fold reduction in C-to-U edits as compared to BE4 with rAPOBEC1 (FIG. 19A). Notably, treatment of cells with BE4s containing RrA3F or SsAPOBEC2, led to frequencies of C-to-U edits that were comparable to those of cells treated with nCas9 (D10A) alone. In addition, deep-sequencing analysis of selected regions in the transcriptome revealed C-to-U editing outcomes consistent with those of whole transcriptome sequencing data (FIG. 19B). Considered together, these results indicated that the next-generation CBEs provide reduced spurious deamination in the cellular transcriptome compared to BE3 or 4 containing rAPOBEC1.

Figure 19C:
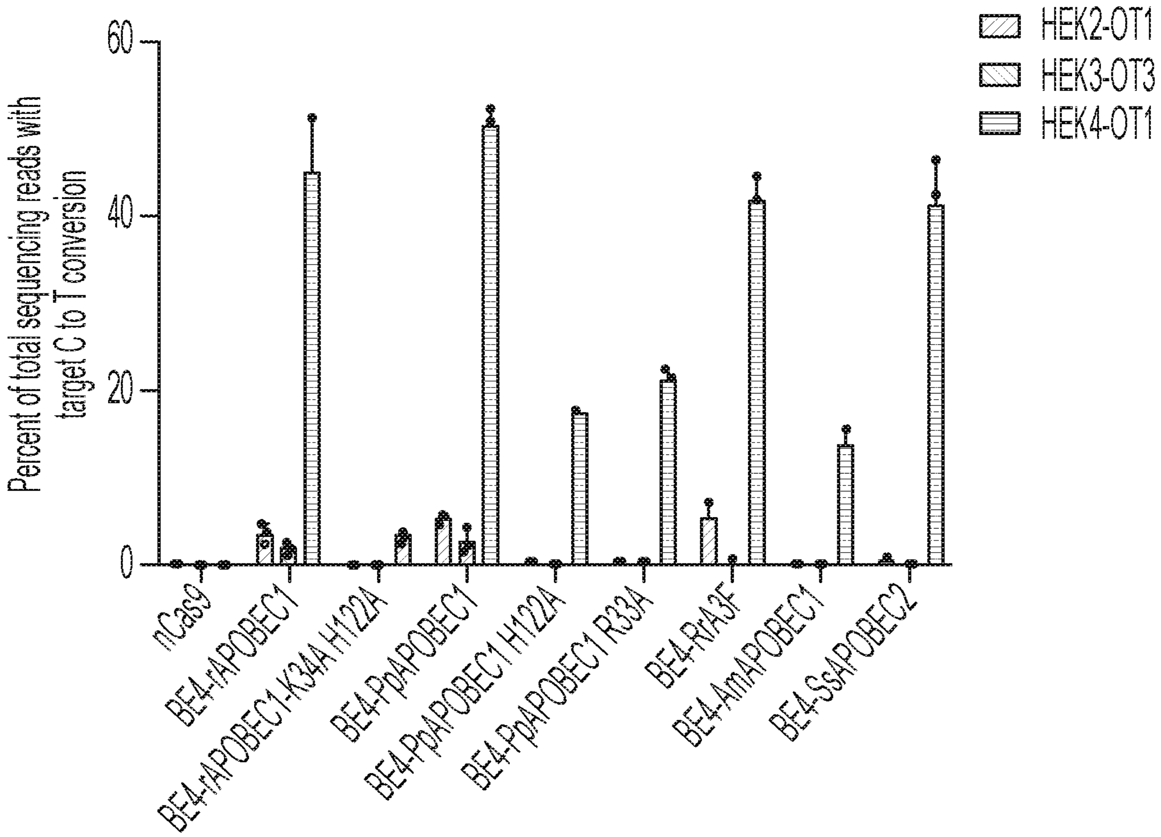

Guide-dependent DNA off-target editing at known Cas9 off-target loci associated with 3 SpCas9 sgRNAs were also evaluated. Guide-dependent off-target activities of BE4 with PpAPOBEC1 were found to be similar to the activity of BE4 with rAPOBEC1 (FIG. 19C and FIGS. 28A-28D). Of note, some next-generation CBEs showed reduced guide-dependent off-target editing for at least one sgRNA tested, and the HiFi mutations described supra also reduced guide-dependent off-target editing efficiency (FIG. 19C and FIGS. 28A-28D). By way of example, at three of the most highly-edited, off-target sites (i.e., Hek2, site1; Hek3, site3; Hek4, site1), cells treated with BE4 containing AmAPOBEC1 engendered at least 18.8, 26.7, and 3.3-fold reduction, respectively, in guide-dependent off-target editing compared to BE4 with rAPOBEC1. (FIG. 19C). Notably, BE4 with PpAPOBEC1 H122A showed more than a 3-fold reduction in guide-dependent off-target editing than BE4 with PpAPOBEC1 at these three sites, with no observable decrease in on-target editing (FIG. 19C). These data and results indicate that next-generation CBEs can yield more favorable or equivalent guided off-target editing profiles compared to those of BE4 containing rAPOBEC1. Furthermore, to validate that base editing outcomes resulting from the described next-generation CBES were not due to differences in editor expression, the amount of protein produced from cells transfected with the described next-generation CBEs and BE4 were quantified. It was found that that next-generation CBE protein levels were comparable to the amounts observed for BE4.

Figure 30:
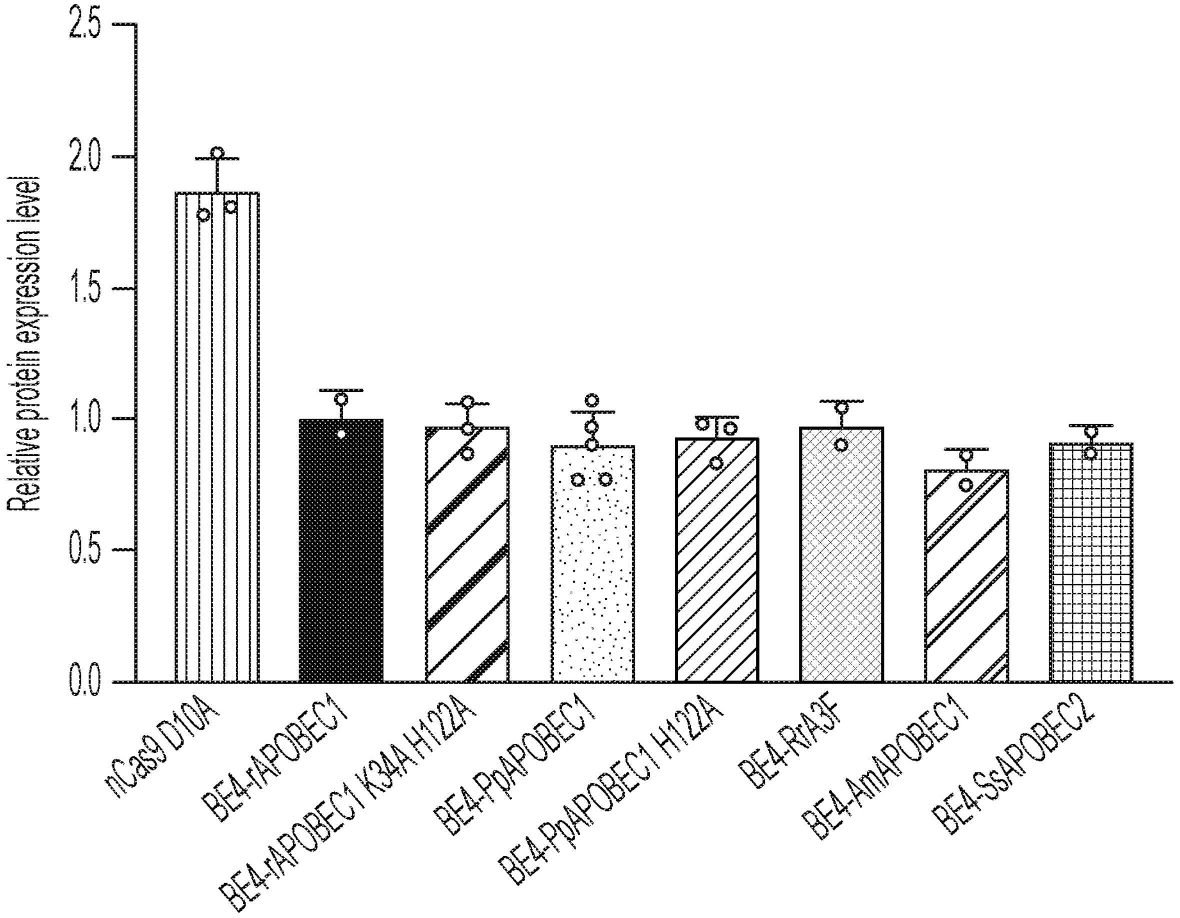
FIG. 30 presents a graph showing quantification of CBE protein concentration in HEK293T cells transfected with base editor expression plasmids. Base editor protein concentration was quantified by measuring the total Cas9 protein concentration and the amount of total protein in a cell lysate. BE protein concentration was normalized to BE4-rAPOBEC1. Values and error bars reflect the mean and s.d. of two or more independent biological replicates.

To examine if different protein expression levels of editors contributed to changes in cis/trans editing profile, the quantification of base editor mRNA and protein was performed on cells transfected with editor plasmids (FIG. 30). It was demonstrated that HiFi mutations like K34A and H122A did not cause significant changes in base editor transcription and translation. For each of the four, new CBEs characterized as described, the protein expression level was not dramatically lower than that of BE4-rAPOBEC1 (FIG. 30). Without wishing to be bound by theory, the changes in cis/trans editing profile arose from the intrinsic characteristics of deaminases.

Figure 29:
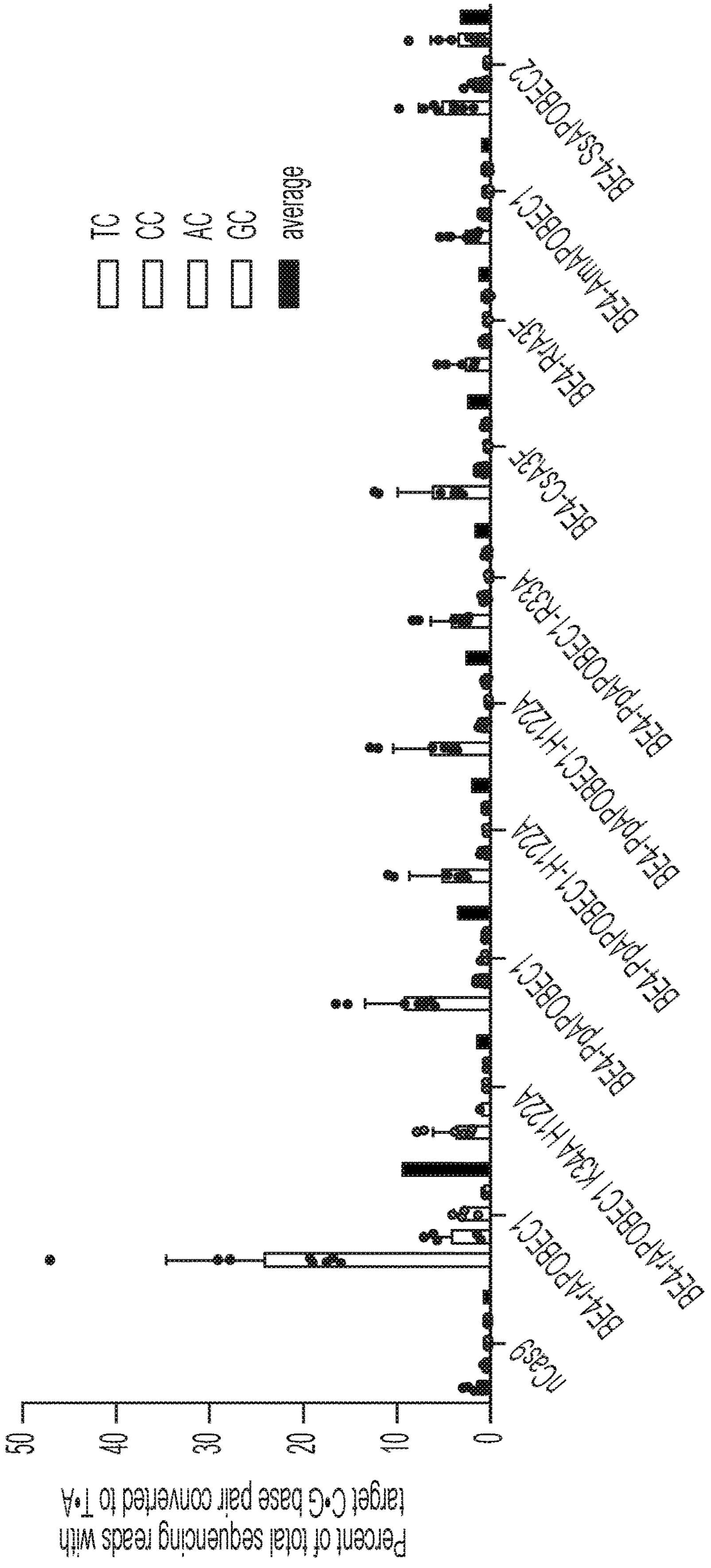
FIG. 29 presents a graph showing C to T editing efficiency of selected CBEs on ssDNA substrates in in vitro enzymatic assay. The editing efficiencies were measured at all 25 cytidines in 2 ssDNA substrates, and grouped by NC sequence context. Sequences of the two substrates used are listed in Table 18 herein. Values and error bars reflect the mean and s.d. of data obtained from independent biological duplicates.

To perform a secondary evaluation of unguided DNA off-target editing, an in vitro assay was developed utilizing free, synthetic ssDNA and CBE protein, as a further validation of the results obtained with the in cislin trans assay described supra. Total cell lysate that contained base editor proteins was harvested from cells, normalized, and mixed with two, synthesized oligonucleotides (oligos) that contained 11 or 13 cytosines between cytosine-free adaptors, covering all NC motifs. In this assay, six next-generation CBE editors showed an average of 1.0-3.4% C-to-U editing efficiency as compared to that of BE4 with rAPOBEC1, which has an average of 9.4% C-to-U (data are across all 24 Cs contained within the two substrates (FIG. 19D and FIG. 29).

Figure 19D:
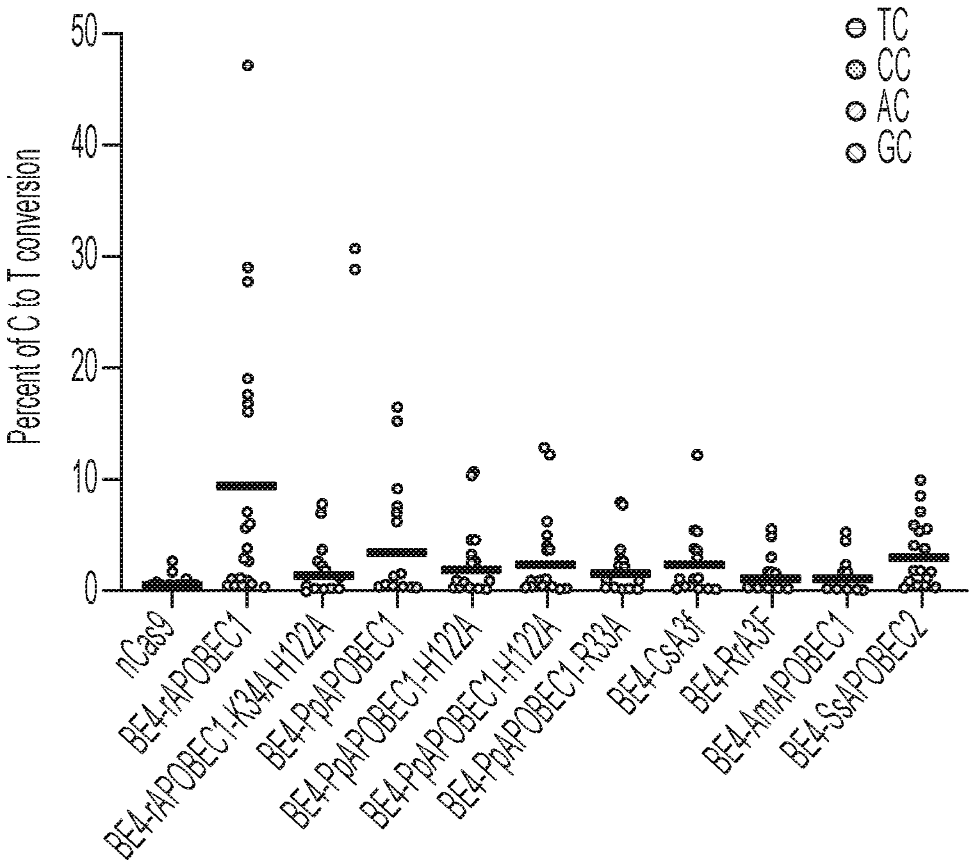
Figure 19E:
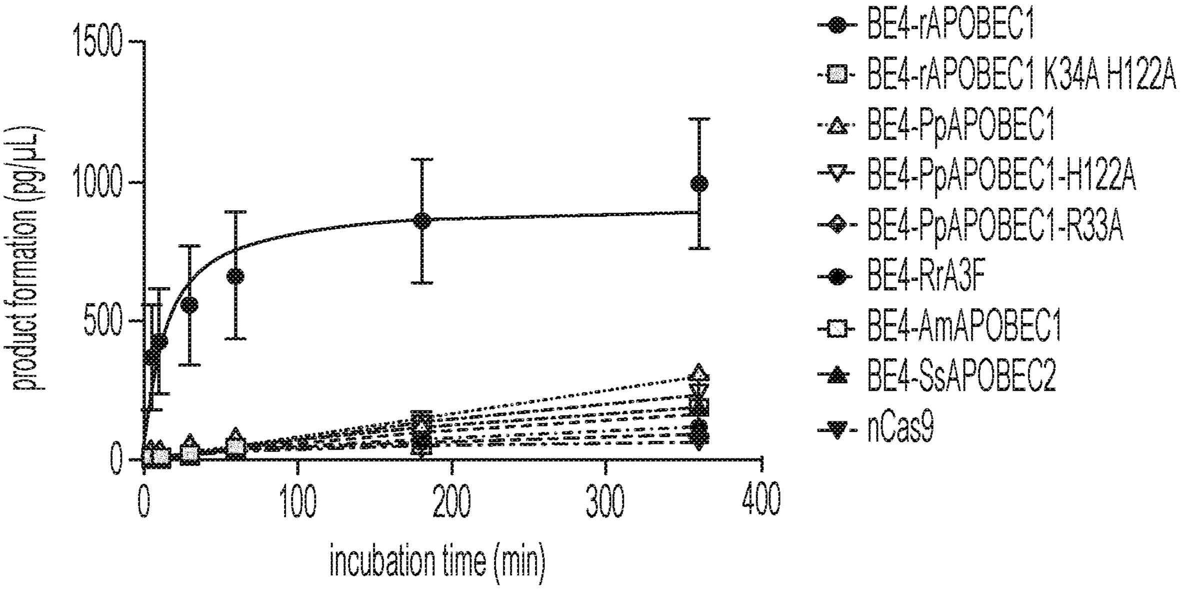

The increased ssDNA editing activity of BE4 containing rAPOBEC1, relative to the next-generation CBEs as described herein, was further supported by performing a time-course assay in which both the absolute level and the apparent rate of deamination by BE4 with rPOABEC1 was greater than that of the described next-generation CBEs (FIG. 19E). In the time-course assay, 12 to 37-fold more C-to-U containing ssDNA was observed at 5 minutes, and 2.2 to 9.6-fold more product was formed at 6 hours by BE4 with rAPOBEC1 compared to the described next-generation CBEs described supra (FIG. 19E).

The DNA sequences of the oligos used in the described studies and in FIGS. 19D and 19E are listed in Table 17 presented below. Primers for guided off-target and targeted RNA-seq are as reported by Tsai, S. Q. et al. (*Nat Biotechnol,* 33:187-197 (2015)) and by Rees, H. A., et al., (*Sci Adv,*

5, eaax5717 (2019)), respectively. Oligos used in vitro assays (adaptor sequences are underlined; * indicates phosphorothioate bonds):

oligo 1 (FIG. 19D):
(SEQ ID NO: 326)
G*G*TGGTTTGTGTATTGGGTGCCTTCTATTTCCAGCTCGAAGCGAAAA
AACAGATAAGTTCATAACCGCATGTAGGAATTTTGGTGGGA*T*A -continued oligo 2 (FIG. 19D):
(SEQ ID NO: 327)
G*G*TGGTTTGTGTATTGGGTGTATCTTAACAATGTTAATAACGTATAA
AGGCTGTTCATTCCCTCGCGCATGTAGGAATTTTGGTGGGA*T*A oligo 3 (FIG. 19E):
(SEQ ID NO: 328)
T*G*GTTTGTGTATTGGGTGAAGGTGAAAGGGTGAAAAAAATTGTCTGT
AAGTAAGGGTGGTAAAGAATAAATGTAGGAATTTTGGTGGG*A*T

TABLE 17

HTS primers:

| Primer name | Primer sequence (5' to 3') | SEQ ID NO: |
|---|---|---|
| HTS-FP-site1 | ACACTCTTTCCCTACACGACGCTCTTCCGATCTACTGTCTTTTGATCTACAGCAGTTAAT | 329 |
| HTS-FP-site2 | ACACTCTTTCCCTACACGACGCTCTTCCGATCTAGCCTCTTTCCTGCTAGAGC | 330 |
| HTS-FP-site3 | ACACTCTTTCCCTACACGACGCTCTTCCGATCTCTTTCGCTGCCCTTTCCTCT | 331 |
| HTS-FP-site4 | ACACTCTTTCCCTACACGACGCTCTTCCGATCTGATATCTCCAGGCTCCTGTCCATTCT | 332 |
| HTS-FP-site5 | ACACTCTTTCCCTACACGACGCTCTTCCGATCTCCATCCTAAGTGAAGCAGCATATTTGA | 333 |
| HTS-FP-site6 | ACACTCTTTCCCTACACGACGCTCTTCCGATCTAGGTGGGGGTGACTCCTTTTTTGGA | 334 |
| HTS-FP-site7 | ACACTCTTTCCCTACACGACGCTCTTCCGATCTCTTGTCTGTCCAAGGAGAATGAGGTC | 335 |
| HTS-FP-site8 | ACACTCTTTCCCTACACGACGCTCTTCCGATCTGACCTGGAGGCCTGGGATCCACA | 336 |
| HTS-FP-site9 | ACACTCTTTCCCTACACGACGCTCTTCCGATCTCCTTTAGGACACATGCTGTCTACCACA | 337 |
| HTS-FP-site10 | ACACTCTTTCCCTACACGACGCTCTTCCGATCTGCCAAAGTCTGAGGTTTAGTTGACTAA | 338 |
| HTS-FP-site11 | ACACTCTTTCCCTACACGACGCTCTTCCGATCTGTGGGAACATCACCGGAGCCTGG | 339 |
| HTS-FP-site12 | ACACTCTTTCCCTACACGACGCTCTTCCGATCTCTGACACTAAATATGTGGTTTTTTGCT | 340 |
| HTS-FP-site13 | ACACTCTTTCCCTACACGACGCTCTTCCGATCTCGAACTCCTAGGCTCAAGTAATCCA | 341 |
| HTS-FP-site14 | ACACTCTTTCCCTACACGACGCTCTTCCGATCTGCCAGTAATTGCATTAAACCCTCACTA | 342 |
| HTS-FP-site15 | ACACTCTTTCCCTACACGACGCTCTTCCGATCTGGCTCCCACTCTCTCCCAGTGTCCTCA | 343 |
| HTS-FP-site16 | ACACTCTTTCCCTACACGACGCTCTTCCGATCTTCTGCCTGTGTGAAGCTCCC | 344 |
| HTS-FP-site17 | ACACTCTTTCCCTACACGACGCTCTTCCGATCTGGGAGTCCTCCCTTCACCCCTGC | 345 |
| HTS-FP-site18 | ACACTCTTTCCCTACACGACGCTCTTCCGATCTGTGCCAAGGCATAAAAGCCTTCCCTG | 346 |
| HTS-FP-site19 | ACACTCTTTCCCTACACGACGCTCTTCCGATCTACTCGCTGGCCTGGCCTTTCTTCTC | 347 |
| HTS-FP-site20 | ACACTCTTTCCCTACACGACGCTCTTCCGATCTAAGCGGGTTCTCATTGTTCCCGTGTCT | 348 |
| HTS-FP-site21 | ACACTCTTTCCCTACACGACGCTCTTCCGATCTAACCAGTCCCTGTCCTGAATCTATCTA | 349 |
| HTS-FP-site22 | ACACTCTTTCCCTACACGACGCTCTTCCGATCTTTGCTTTCGGGTATCTACTAGGAGTCA | 350 |
| HTS-FP-site23 | ACACTCTTTCCCTACACGACGCTCTTCCGATCTGGGGCTGGGCTTGCGTTGCCGCT | 351 |
| HTS-FP-site24 | ACACTCTTTCCCTACACGACGCTCTTCCGATCTGGGCTATCAAACCTCATGATTGGC | 352 |
| HTS-FP-site25 | ACACTCTTTCCCTACACGACGCTCTTCCGATCTAAGCTGTCCAGCTGGAAGCCTGGTAA | 353 |
| HTS-FP-site26 | ACACTCTTTCCCTACACGACGCTCTTCCGATCTGCCTAAGTTATATGCAAACATCATGCC | 354 |
| HTS-FP-site27 | ACACTCTTTCCCTACACGACGCTCTTCCGATCTGCTGCTGGAATACCGAGGAC | 355 |
| HTS-FP-site28 | ACACTCTTTCCCTACACGACGCTCTTCCGATCTACGAGGTAAGTGTGTGGATTAGTTTCA | 356 |
| HTS-FP-site29 | ACACTCTTTCCCTACACGACGCTCTTCCGATCTAGTGGTTACTTTGCCGGGTT | 357 |
| HTS-FP-site30 | ACACTCTTTCCCTACACGACGCTCTTCCGATCTNNNNGAACCCAGGTAGCCAGAGAC | 358 |
| HTS-FP-site31 | ACACTCTTTCCCTACACGACGCTCTTCCGATCTNNNNCATTGCAGAGAGGCGTATCA | 359 |
| HTS-FP-site32 | ACACTCTTTCCCTACACGACGCTCTTCCGATCTNNNNCAGAGTGCTGCTTGCTGCT | 360 |

TABLE 17-continued

| HTS primers: | | |
|---|---|---|
| Primer name | Primer sequence (5' to 3') | SEQ ID NO: |
| HTS-FP-site33 | ACACTCTTTCCCTACACGACGCTCTTCCGATCTTTTAGTGACTAGCCGCCACC | 361 |
| HTS-FP-site34 | ACACTCTTTCCCTACACGACGCTCTTCCGATCTNNNNGAAACCATGTCTCTGGATGCC | 362 |
| HTS-FP-site35 | ACACTCTTTCCCTACACGACGCTCTTCCGATCTNNNNAGGCCTTTTCTTGGGGATGC | 363 |
| HTS-RP-site1 | TGGAGTTCAGACGTGTGCTCTTCCGATCTAAGAAACAGATTACAGAAGTAGATGCA | 364 |
| HTS-RP-site2 | TGGAGTTCAGACGTGTGCTCTTCCGATCTTCTCTCCTATGTGCTGGCCT | 365 |
| HTS-RP-site3 | TGGAGTTCAGACGTGTGCTCTTCCGATCTCTACACTGGAACCCCGACTC | 366 |
| HTS-RP-site4 | TGGAGTTCAGACGTGTGCTCTTCCGATCTCCAGCCGATATTTCAGAACTAATCAGA | 367 |
| HTS-RP-site5 | TGGAGTTCAGACGTGTGCTCTTCCGATCTAACAATGGCAAGGGCCTGCCCTG | 368 |
| HTS-RP-site6 | TGGAGTTCAGACGTGTGCTCTTCCGATCTGGGCAGAAGGAAAAATCTATCCTGGAA | 369 |
| HTS-RP-site7 | TGGAGTTCAGACGTGTGCTCTTCCGATCTGCACAGAACCCGCTGCTAGAGACTCCA | 370 |
| HTS-RP-site8 | TGGAGTTCAGACGTGTGCTCTTCCGATCTGGAAAGTCTGGTTAGAGCTCAGAGGGA | 371 |
| HTS-RP-site9 | TGGAGTTCAGACGTGTGCTCTTCCGATCTGTGGTGGAGTGCTCTGTGTTTGTCT | 372 |
| HTS-RP-site10 | TGGAGTTCAGACGTGTGCTCTTCCGATCTATTACAGGTGTGGGCCACCTTGCCC | 373 |
| HTS-RP-site11 | TGGAGTTCAGACGTGTGCTCTTCCGATCTTGCATAACCTACACACATCCTCTGATA | 374 |
| HTS-RP-site12 | TGGAGTTCAGACGTGTGCTCTTCCGATCTGGATTGCGGAAATCCCCAACTTATAGC | 375 |
| HTS-RP-site13 | TGGAGTTCAGACGTGTGCTCTTCCGATCTGCCTGGACTCCAGACAGGCTTCC | 376 |
| HTS-RP-site14 | TGGAGTTCAGACGTGTGCTCTTCCGATCTAAGGCCAAGAATCTTGCTAGTAGTGGA | 377 |
| HTS-RP-site15 | TGGAGTTCAGACGTGTGCTCTTCCGATCTGGATAGAGCAAAAGAAGTAGTGCCTGG | 378 |
| HTS-RP-site16 | TGGAGTTCAGACGTGTGCTCTTCCGATCTTGAAACTGTCACTGAAACATCTGGT | 379 |
| HTS-RP-site17 | TGGAGTTCAGACGTGTGCTCTTCCGATCTGTTCTCAAGAAAAGGCCACCCCTCAG | 380 |
| HTS-RP-site18 | TGGAGTTCAGACGTGTGCTCTTCCGATCTTGCTTAGAGGGTAAAAACCCAGGAGGA | 381 |
| HTS-RP-site19 | TGGAGTTCAGACGTGTGCTCTTCCGATCTGGGAGAGAGGCAGGGCGGGCATG | 382 |
| HTS-RP-site20 | TGGAGTTCAGACGTGTGCTCTTCCGATCTTCCGCCTCCGGAGTAGGGCTGCAGAGA | 383 |
| HTS-RP-site21 | TGGAGTTCAGACGTGTGCTCTTCCGATCTGGAAGGCAGACTGTATCTGGTCTTTT | 384 |
| HTS-RP-site22 | TGGAGTTCAGACGTGTGCTCTTCCGATCTTCTAGCAGGAAAGAGGCTCAGGCCCA | 385 |
| HTS-RP-site23 | TGGAGTTCAGACGTGTGCTCTTCCGATCTAGACCGAGTGGCAGTGACAGCAAGC | 386 |
| HTS-RP-site24 | TGGAGTTCAGACGTGTGCTCTTCCGATCTACACACAGACACTGCAGAGAATAACA | 387 |
| HTS-RP-site25 | TGGAGTTCAGACGTGTGCTCTTCCGATCTCCGCCCAGCACTCGCAGAGCAGA | 388 |
| HTS-RP-site26 | TGGAGTTCAGACGTGTGCTCTTCCGATCTGATGAGAATGCACCATGATTCCAATCA | 389 |
| HTS-RP-site27 | TGGAGTTCAGACGTGTGCTCTTCCGATCTGCAACTCTCTTTTCTCCGGGA | 390 |
| HTS-RP-site28 | TGGAGTTCAGACGTGTGCTCTTCCGATCTCTACCAAGGAGAGTCATTCCTTTCAGA | 391 |
| HTS-RP-site29 | TGGAGTTCAGACGTGTGCTCTTCCGATCTAAGACAGTCTGGGAAGCGTG | 392 |
| HTS-RP-site30 | TGGAGTTCAGACGTGTGCTCTTCCGATCTTCCTTTCAACCCGAACGGAG | 393 |
| HTS-RP-site31 | TGGAGTTCAGACGTGTGCTCTTCCGATCTGGGGTCCCAGGTGCTGAC | 394 |
| HTS-RP-site32 | TGGAGTTCAGACGTGTGCTCTTCCGATCTAAAAGGGAGATTGGAGACACGGAGA | 395 |
| HTS-RP-site33 | TGGAGTTCAGACGTGTGCTCTTCCGATCTTGCGCTTTACAGGTCTCCAG | 396 |
| HTS-RP-site34 | TGGAGTTCAGACGTGTGCTCTTCCGATCTAGAGAAATCACACTAGCTAGCCT | 397 |

TABLE 17-continued

| HTS primers: | | |
|---|---|---|
| Primer name | Primer sequence (5' to 3') | SEQ ID NO: |
| HTS-RP-site35 | TGGAGTTCAGACGTGTGCTCTTCCGATCTAGAGAAATCACACTAGCTAGCCT | 397 |
| HTS-FP-ssoligo | ACACTCTTTCCCTACACGACGCTCTTCCGATCTNNNNGGTGGTTTGTGTATTGGGTG | 398 |
| HTS-RP-ssoligo | TGGAGTTCAGACGTGTGCTCTTCCGATCTTATCCCACCAAAATTCCTACAT | 399 |

The polynucleotide sequences of sgRNAs used in the Examples (Examples 2-5) described infra are provided in Table 18. Target sites for guided off-target and targeted RNA-seq as described in Example 5.

*S. pyogenes* SgRNA scaffold:
(SEQ ID NO: 400)
GUUUUAGAGCUAGAAAUAGCAAGUUAAAAUAAGGCUAGUCCGUUAUCAA
CUUGAAAAAGUGGCACCGAGUCGGUGC

*S. aureus* SgRNA scaffold:
(SEQ ID NO: 401)
GUUUUAGUACUCUGUAAUGAAAAUUACAGAAUCUACUAAAACAAGGCAA
AAUGCCGUGUUUAUCUCGUCAACUUGUUGGCGAGA

TABLE 18

| site | spacer sequence | SEQ ID NO: | PAM | Cas9 scaffold | PAM | Cas9 scaffold |
|---|---|---|---|---|---|---|
| 1 | GAUGUGUCUACUGUUACUUACA | 402 | AGGAAT | *S. aureus* | AGG | *S. pyogenes* |
| 2 | GCACCCAGGGGUUCUGCAGAGC | 403 | AGGGAT | *S. aureus* | AGG | *S. pyogenes* |
| 3 | GCAUUCCACUCCGUCCGCCUC | 404 | CGGAGT | *S. aureus* | CGG | *S. pyogenes* |
| 4 | GCCACAGACUUUUCCAUUUGC | 405 | AGGAGT | *S. aureus* | AGG | *S. pyogenes* |
| 5 | GCCACAGUGGGAGGGGACAUG | 406 | GGGAAT | *S. aureus* | GGG | *S. pyogenes* |
| 6 | GCCCAGCAAUUCACUGUGAAG | 407 | AGGGAT | *S. aureus* | AGG | *S. pyogenes* |
| 7 | GCCCAGCUCCAGCCUCUGAUG | 408 | AGGGGT | *S. aureus* | AGG | *S. pyogenes* |
| 8 | GCCCUGAUCUGCACUGAACAG | 409 | AGGGGT | *S. aureus* | AGG | *S. pyogenes* |
| 9 | GCCUCAAGUCUGGUUAUUUUAG | 410 | GGGGAT | *S. aureus* | GGG | *S. pyogenes* |
| 10 | GCCUGGCAGAUGAGAACCAGG | 411 | AGGAAT | *S. aureus* | AGG | *S. pyogenes* |
| 11 | GUAUUACUAUUAUUAUCUGAGA | 412 | TGGGGT | *S. aureus* | TGG | *S. pyogenes* |
| 12 | GUGGGACUGAUCCCUUAAUGUG | 413 | TGGGGT | *S. aureus* | TGG | *S. pyogenes* |
| 13 | GAAAGAGACAGAGAAGGGGCA | 414 | GGGGGT | *S. aureus* | GGG | *S. pyogenes* |
| 14 | GAAGGCUUUACUGUAUUACAGA | 415 | AGGGGT | *S. aureus* | AGG | *S. pyogenes* |
| 15 | GACCAAAACGAGGGACAUUUA | 416 | GGGGAT | *S. aureus* | GGG | *S. pyogenes* |
| 16 | GACCAGGUCAGCAAACAUGUU | 417 | TGGAAT | *S. aureus* | TGG | *S. pyogenes* |
| 17 | GACUCAGCGCCCCUGCCGGGCC | 418 | TGGGAT | *S. aureus* | TGG | *S. pyogenes* |
| 18 | GAGAAGAAACCAGGGAACAGGU | 419 | AGGAGT | *S. aureus* | AGG | *S. pyogenes* |
| 19 | GAGUGGGAACUUUCUGAUGCCA | 420 | TGGAAT | *S. aureus* | TGG | *S. pyogenes* |
| 20 | GCGAAAGGCUCGCGGCGAAGGA | 421 | AGGAAT | *S. aureus* | AGG | *S. pyogenes* |
| 21 | GCUCCUCUCACCCUUAUGACUC | 422 | AGGGAT | *S. aureus* | AGG | *S. pyogenes* |

TABLE 18-continued

| site | spacer sequence | SEQ ID NO: | PAM | Cas9 scaffold | PAM | Cas9 scaffold |
|---|---|---|---|---|---|---|
| 22 | GCUGCAAGGGUUGGCCAGGCU | 423 | GGGAAT | *S. aureus* | GGG | *S. pyogenes* |
| 23 | GGAGCCAGAGACCAGUGGGCA | 424 | GGGGGT | *S. aureus* | GGG | *S. pyogenes* |
| 24 | GGCCUCCGUAUCACUCUCUGAC | 425 | TGGGGT | *S. aureus* | TGG | *S. pyogenes* |
| 25 | GGGUACCUGAGUGGGGUGCAUU | 426 | TGGGGT | *S. aureus* | TGG | *S. pyogenes* |
| 26 | GGUCGACCCUUGGUAUCCAUG | 427 | GGGGAT | *S. aureus* | GGG | *S. pyogenes* |
| 27 | GGUCGUAGCCAGUCCGAACCC | 428 | CGGAGT | *S. aureus* | CGG | *S. pyogenes* |
| 28 | GUAACUGAACCCCUGCAAUCAA | 429 | TGGGAT | *S. aureus* | TGG | *S. pyogenes* |
| 29 | GGCCUCCGUAUCACUCUCUGAC | 425 | TGGGGT | *S. aureus* | TGG | *S. pyogenes* |
| 30 | GUGGCACUGCGGCUGGAGGU | 430 | GGGGGT | *S. aureus* | GGG | *S. pyogenes* |
| 31 | GUAGGGCCUUCGCGCACCUCA | 431 | TGGAAT | *S. aureus* | TGG | *S. pyogenes* |
| 32 | GGCCUCCCCAAAGCCUGGCCA | 432 | GGGAGT | *S. aureus* | GGG | *S. pyogenes* |
| 33 | GAGUCCCAAGAUGUGCCCUGGG | 433 | AGGAGT | *S. aureus* | AGG | *S. pyogenes* |
| 34 | GCACAUUCACGGUCUCAGUGC | 434 | AAGGAT | *S. aureus* | AAG | *S. pyogenes* |
| 35 | GGAAACCUUGAAUAAGAAUGGA | 435 | AGGGGT | *S. aureus* | AGG | *S. pyogenes* |

The DNA sequences of mammalian expression plasmids for the core CBEs shown in the studies described in Examples 2-5 supra are presented in below. The deaminase sequence is underlined for BE4-rAPOBEC1. For the other constructs, only the deaminase sequences are shown, as the backbone sequences are identical.

BE4-rAPOBEC1

(SEQ ID NO: 436)

TGCTTCGCGATGTACGGGCCAGATATACGCGTTGACATTGATTATTGACTAGTTATTAATAGTAATCAATTACGG

GGTCATTAGTTCATAGCCCATATATGGAGTTCCGCGTTACATAACTTACGGTAAATGGCCCGCCTGGCTGACCGC

CCAACGACCCCCGCCCATTGACGTCAATAATGACGTATGTTCCCATAGTAACGCCAATAGGGACTTTCCATTGAC

GTCAATGGGTGGAGTATTTACGGTAAACTGCCCACTTGGCAGTACATCAAGTGTATCATATGCCAAGTACGCCCC

CTATTGACGTCAATGACGGTAAATGGCCCGCCTGGCATTATGCCCAGTACATGACCTTATGGGACTTTCCTACTT

GGCAGTACATCTACGTATTAGTCATCGCTATTACCATGGTGATGCGGTTTTGGCAGTACATCAATGGGCGTGGAT

AGCGGTTTGACTCACGGGGATTTCCAAGTCTCCACCCCATTGACGTCAATGGGAGTTTGTTTTGGCACCAAAATC

AACGGGACTTTCCAAAATGTCGTAACAACTCCGCCCCATTGACGCAAATGGGCGGTAGGCGTGTACGGTGGGAGG

TCTATATAAGCAGAGCTGGTTTAGTGAACCGTCAGATCCGCTAGAGATCCGCGGCCGCTAATACGACTCACTATA

GGGAGAGCCGCCACCATGAGCAGCGAGACAGGCCCTGTGGCCGTGGACCCCACCCTGCGGCGGAGAATCGAGCCT

CATGAGTTCGAGGTGTTCTTCGACCCTCGGGAACTGAGAAAAGAGACATGCCTGCTGTACGAGATCAACTGGGGC

GGAAGACACAGCATCTGGCGGCACACCAGCCAGAACACCAACAAGCACGTGGAAGTGAATTTCATCGAGAAGTTC

ACCACCGAAAGATACTTCTGCCCCAACACCAGATGCAGCATCACATGGTTCCTGTCTTGGTCCCCTTGCGGCGAG

TGCTCTAGAGCCATCACCGAGTTCCTGAGCAGATATCCTCACGTGACACTGTTCATCTACATCGCCAGACTGTAT

CACCACGCCGATCCTAGAAATAGACAGGGCCTGCGGGACCTGATCAGCTCCGGCGTGACCATCCAGATCATGACC

GAGCAGGAGAGCGGCTACTGTTGGAGAAACTTCGTGAACTACTCTCCTAGCAACGAGGCCCACTGGCCTAGATAC

CCCCACCTGTGGGTGCGGCTGTACGTGCTGGAACTGTACTGCATCATCCTGGGACTGCCTCCATGTCTGAACATC

CTGAGAAGAAAGCAGCCTCAGCTGACCTTCTTCACAATCGCCCTGCAGAGCTGCCACTACCAGAGACTGCCCCCC

CACATCCTGTGGGCCACCGGCCTGAAGCTTAAGAGCGGAGGATCTCTTAAGAGCGGAGGATCTAGCGGCGGCTCT

-continued

AGCGGATCTGAGACACCTGGCACAAGCGAGTCTGCCACACCTGAGAGTAGCGGCGGATCTTCTGGTGGCTCTGAC

AAGAAGTACAGCATCGGCCTGGCCATCGGCACCAACTCTGTGGGCTGGGCCGTGATCACCGACGAGTACAAGGTG

CCCAGCAAGAAATTCAAGGTGCTGGGCAACACCGACCGGCACAGCATCAAGAAGAACCTGATCGGAGCCCTGCTG

TTCGACAGCGGCGAAACAGCCGAGGCCACCCGGCTGAAGAGAACCGCCAGAAGAAGATACACCAGACGGAAGAAC

CGGATCTGCTATCTGCAAGAGATCTTCAGCAACGAGATGGCCAAGGTGGACGACAGCTTCTTCCACAGACTGGAA

GAGTCCTTCCTGGTGGAAGAGGATAAGAAGCACGAGCGGCACCCCATCTTCGGCAACATCGTGGACGAGGTGGCC

TACCACGAGAAGTACCCCACCATCTACCACCTGAGAAAGAAACTGGTGGACAGCACCGACAAGGCCGACCTGCGG

CTGATCTATCTGGCCCTGGCCCACATGATCAAGTTCCGGGGCCACTTCCTGATCGAGGGCGACCTGAACCCCGAC

AACAGCGACGTGGACAAGCTGTTCATCCAGCTGGTGCAGACCTACAACCAGCTGTTCGAGGAAAACCCCATCAAC

GCCAGCGGCGTGGACGCCAAGGCCATCCTGTCTGCCAGACTGAGCAAGAGCAGACGGCTGGAAAATCTGATCGCC

CAGCTGCCCGGCGAGAAGAAGAATGGCCTGTTCGGAAACCTGATTGCCCTGAGCCTGGGCCTGACCCCCAACTTC

AAGAGCAACTTCGACCTGGCCGAGGATGCCAAACTGCAGCTGAGCAAGGACACCTACGACGACGACCTGGACAAC

CTGCTGGCCCAGATCGGCGACCAGTACGCCGACCTGTTTCTGGCCGCCAAGAACCTGTCCGACGCCATCCTGCTG

AGCGACATCCTGAGAGTGAACACCGAGATCACCAAGGCCCCCCTGAGCGCCTCTATGATCAAGAGATACGACGAG

CACCACCAGGACCTGACCCTGCTGAAAGCTCTCGTGCGGCAGCAGCTGCCTGAGAAGTACAAAGAGATTTTCTTC

GACCAGAGCAAGAACGGCTACGCCGGCTACATTGACGGCGGAGCCAGCCAGGAAGAGTTCTACAAGTTCATCAAG

CCCATCCTGGAAAAGATGGACGGCACCGAGGAACTGCTCGTGAAGCTGAACAGAGAGGACCTGCTGCGGAAGCAG

CGGACCTTCGACAACGGCAGCATCCCCCACCAGATCCACCTGGGAGAGCTGCACGCCATTCTGCGGCGGCAGGAA

GATTTTTACCCATTCCTGAAGGACAACCGGGAAAAGATCGAGAAGATCCTGACCTTCCGCATCCCCTACTACGTG

GGCCCTCTGGCCAGGGGAAACAGCAGATTCGCCTGGATGACCAGAAAGAGCGAGGAAACCATCACCCCCTGGAAC

TTCGAGGAAGTGGTGGACAAGGGCGCTTCCGCCCAGAGCTTCATCGAGCGGATGACCAACTTCGATAAGAACCTG

CCCAACGAGAAGGTGCTGCCCAAGCACAGCCTGCTGTACGAGTACTTCACCGTGTATAACGAGCTGACCAAAGTG

AAATACGTGACCGAGGGAATGAGAAAGCCCGCCTTCCTGAGCGGCGAGCAGAAAAAGGCCATCGTGGACCTGCTG

TTCAAGACCAACCGGAAAGTGACCGTGAAGCAGCTGAAAGAGGACTACTTCAAGAAAATCGAGTGCTTCGACTCC

GTGGAAATCTCCGGCGTGGAAGATCGGTTCAACGCCTCCCTGGGCACATACCACGATCTGCTGAAAATTATCAAG

GACAAGGACTTCCTGGACAATGAGGAAAACGAGGACATTCTGGAAGATATCGTGCTGACCCTGACACTGTTTGAG

GACAGAGAGATGATCGAGGAACGGCTGAAAACCTATGCCCACCTGTTCGACGACAAAGTGATGAAGCAGCTGAAG

CGGCGGAGATACACCGGCTGGGGCAGGCTGAGCCGGAAGCTGATCAACGGCATCCGGGACAAGCAGTCCGGCAAG

ACAATCCTGGATTTCCTGAAGTCCGACGGCTTCGCCAACAGAAACTTCATGCAGCTGATCCACGACGACAGCCTG

ACCTTTAAAGAGGACATCCAGAAAGCCCAGGTGTCCGGCCAGGGCGATAGCCTGCACGAGCACATTGCCAATCTG

GCCGGCAGCCCCGCCATTAAGAAGGGCATCCTGCAGACAGTGAAGGTGGTGGACGAGCTCGTGAAAGTGATGGGC

CGGCACAAGCCCGAGAACATCGTGATCGAAATGGCCAGAGAGAACCAGACCACCCAGAAGGGACAGAAGAACAGC

CGCGAGAGAATGAAGCGGATCGAAGAGGGCATCAAAGAGCTGGGCAGCCAGATCCTGAAAGAACACCCCGTGGAA

AACACCCAGCTGCAGAACGAGAAGCTGTACCTGTACTACCTGCAGAATGGGCGGGATATGTACGTGGACCAGGAA

CTGGACATCAACCGGCTGTCCGACTACGATGTGGACCATATCGTGCCTCAGAGCTTTCTGAAGGACGACTCCATC

GACAACAAGGTGCTGACCAGAAGCGACAAGAACCGGGGCAAGAGCGACAACGTGCCCTCCGAAGAGGTCGTGAAG

AAGATGAAGAACTACTGGCGGCAGCTGCTGAACGCCAAGCTGATTACCCAGAGAAAGTTCGACAATCTGACCAAG

GCCGAGAGAGGCGGCCTGAGCGAACTGGATAAGGCCGGCTTCATCAAGAGACAGCTGGTGGAAACCCGGCAGATC

ACAAAGCACGTGGCACAGATCCTGGACTCCCGGATGAACACTAAGTACGACGAGAATGACAAGCTGATCCGGGAA

GTGAAAGTGATCACCCTGAAGTCCAAGCTGGTGTCCGATTTCCGGAAGGATTTCCAGTTTTACAAAGTGCGCGAG

ATCAACAACTACCACCACGCCCACGACGCCTACCTGAACGCCGTCGTGGGAACCGCCCTGATCAAAAAGTACCCT

-continued

AAGCTGGAAAGCGAGTTCGTGTACGGCGACTACAAGGTGTACGACGTGCGGAAGATGATCGCCAAGAGCGAGCAG

GAAATCGGCAAGGCTACCGCCAAGTACTTCTTCTACAGCAACATCATGAACTTTTTCAAGACCGAGATTACCCTG

GCCAACGGCGAGATCCGGAAGCGGCCTCTGATCGAGACAAACGGCGAAACCGGGGAGATCGTGTGGGATAAGGGC

CGGGATTTTGCCACCGTGCGGAAAGTGCTGAGCATGCCCCAAGTGAATATCGTGAAAAAGACCGAGGTGCAGACA

GGCGGCTTCAGCAAAGAGTCTATCCTGCCCAAGAGGAACAGCGATAAGCTGATCGCCAGAAAGAAGGACTGGGAC

CCTAAGAAGTACGGCGGCTTCGACAGCCCCACCGTGGCCTATTCTGTGCTGGTGGTGGCCAAAGTGGAAAAGGGC

AAGTCCAAGAAACTGAAGAGTGTGAAAGAGCTGCTGGGGATCACCATCATGGAAAGAAGCAGCTTCGAGAAGAAT

CCCATCGACTTTCTGGAAGCCAAGGGCTACAAAGAAGTGAAAAAGGACCTGATCATCAAGCTGCCTAAGTACTCC

CTGTTCGAGCTGGAAAACGGCCGGAAGAGAATGCTGGCCTCTGCCGGCGAACTGCAGAAGGGAAACGAACTGGCC

CTGCCCTCCAAATATGTGAACTTCCTGTACCTGGCCAGCCACTATGAGAAGCTGAAGGGCTCCCCCGAGGATAAT

GAGCAGAAACAGCTGTTTGTGGAACAGCACAAGCACTACCTGGACGAGATCATCGAGCAGATCAGCGAGTTCTCC

AAGAGAGTGATCCTGGCCGACGCTAATCTGGACAAAGTGCTGTCCGCCTACAACAAGCACCGGGATAAGCCCATC

AGAGAGCAGGCCGAGAATATCATCCACCTGTTTACCCTGACCAATCTGGGAGCCCCTGCCGCCTTCAAGTACTTT

GACACCACCATCGACCGGAAGAGGTACACCAGCACCAAAGAGGTGCTGGACGCCACCCTGATCCACCAGAGCATC

ACCGGCCTGTACGAGACACGGATCGACCTGTCTCAGCTGGGAGGTGACTCTGGTGGAAGCGGAGGATCTGGCGGC

AGCACCAATCTGAGCGACATCATCGAGAAAGAGACAGGCAAGCAGCTGGTCATCCAAGAGTCCATCCTGATGCTG

CCTGAAGAGGTGGAAGAAGTGATCGGCAACAAGCCCGAGTCCGACATCCTGGTGCACACCGCCTACGATGAGAGC

ACCGACGAGAACGTGATGCTGCTGACCTCTGACGCCCCTGAGTACAAGCCTTGGGCTCTCGTGATCCAGGACAGC

AACGGCGAGAACAAGATCAAGATGCTGAGCGGCGGCTCTGGTGGCTCTGGCGGATCTACAAACCTGTCCGATATT

ATTGAGAAAGAAACCGGGAAACAGCTCGTGATTCAAGAGTCTATTCTCATGCTCCCGGAAGAAGTCGAGGAAGTC

ATTGGAAACAAGCCTGAGAGCGATATTCTGGTCCATACAGCCTACGACGAGTCTACCGATGAGAATGTCATGCTC

CTCACCAGCGACGCTCCCGAGTATAAGCCATGGGCACTTGTCATTCAGGACTCCAATGGGGAAAACAAAATCAAA

ATGCTCCCAAAGAAAAAACGCAAGGTGGAGGGAGCTGATAAGCGCACCGCCGATGGTTCCGAGTTCGAAAGCCCC

AAGAAGAAGAGGAAAGTCTAACCGGTCATCATCACCATCACCATTGAGTTTAAACCCGCTGATCAGCCTCGACTG

TGCCTTCTAGTTGCCAGCCATCTGTTGTTTGCCCCTCCCCCGTGCCTTCCTTGACCCTGGAAGGTGCCACTCCCA

CTGTCCTTTCCTAATAAAATGAGGAAATTGCATCGCATTGTCTGAGTAGGTGTCATTCTATTCTGGGGGGTGGGG

TGGGGCAGGACAGCAAGGGGGAGGATTGGGAAGACAATAGCAGGCATGCTGGGGATGCGGTGGGCTCTATGGCTT

CTGAGGCGGAAAGAACCAGCTGGGGCTCGATACCGTCGACCTCTAGCTAGAGCTTGGCGTAATCATGGTCATAGC

TGTTTCCTGTGTGAAATTGTTATCCGCTCACAATTCCACACAACATACGAGCCGGAAGCATAAAGTGTAAAGCCT

AGGGTGCCTAATGAGTGAGCTAACTCACATTAATTGCGTTGCGCTCACTGCCCGCTTTCCAGTCGGGAAACCTGT

CGTGCCAGCTGCATTAATGAATCGGCCAACGCGCGGGGAGAGGCGGTTTGCGTATTGGGCGCTCTTCCGCTTCCT

CGCTCACTGACTCGCTGCGCTCGGTCGTTCGGCTGCGGCGAGCGGTATCAGCTCACTCAAAGGCGGTAATACGGT

TATCCACAGAATCAGGGGATAACGCAGGAAAGAACATGTGAGCAAAAGGCCAGCAAAAGGCCAGGAACCGTAAAA

AGGCCGCGTTGCTGGCGTTTTTCCATAGGCTCCGCCCCCCTGACGAGCATCACAAAAATCGACGCTCAAGTCAGA

GGTGGCGAAACCCGACAGGACTATAAAGATACCAGGCGTTTCCCCCTGGAAGCTCCCTCGTGCGCTCTCCTGTTC

CGACCCTGCCGCTTACCGGATACCTGTCCGCCTTTCTCCCTTCGGGAAGCGTGGCGCTTTCTCATAGCTCACGCT

GTAGGTATCTCAGTTCGGTGTAGGTCGTTCGCTCCAAGCTGGGCTGTGTGCACGAACCCCCCGTTCAGCCCGACC

GCTGCGCCTTATCCGGTAACTATCGTCTTGAGTCCAACCCGGTAAGACACGACTTATCGCCACTGGCAGCAGCCA

CTGGTAACAGGATTAGCAGAGCGAGGTATGTAGGCGGTGCTACAGAGTTCTTGAAGTGGTGGCCTAACTACGGCT

ACACTAGAAGAACAGTATTTGGTATCTGCGCTCTGCTGAAGCCAGTTACCTTCGGAAAAAGAGTTGGTAGCTCTT

-continued

GATCCGGCAAACAAACCACCGCTGGTAGCGGTGGTTTTTTTGTTTGCAAGCAGCAGATTACGCGCAGAAAAAAAG

GATCTCAAGAAGATCCTTTGATCTTTTCTACGGGGTCTGACGCTCAGTGGAACGAAAACTCACGTTAAGGGATTT

TGGTCATGAGATTATCAAAAAGGATCTTCACCTAGATCCTTTTAAATTAAAAATGAAGTTTTAAATCAATCTAAA

GTATATATGAGTAAACTTGGTCTGACAGTTACCAATGCTTAATCAGTGAGGCACCTATCTCAGCGATCTGTCTAT

TTCGTTCATCCATAGTTGCCTGACTCCCCGTCGTGTAGATAACTACGATACGGGAGGGCTTACCATCTGGCCCCA

GTGCTGCAATGATACCGCGAGACCCACGCTCACCGGCTCCAGATTTATCAGCAATAAACCAGCCAGCCGGAAGGG

CCGAGCGCAGAAGTGGTCCTGCAACTTTATCCGCCTCCATCCAGTCTATTAATTGTTGCCGGGAAGCTAGAGTAA

GTAGTTCGCCAGTTAATAGTTTGCGCAACGTTGTTGCCATTGCTACAGGCATCGTGGTGTCACGCTCGTCGTTTG

GTATGGCTTCATTCAGCTCCGGTTCCCAACGATCAAGGCGAGTTACATGATCCCCCATGTTGTGCAAAAAAGCGG

TTAGCTCCTTCGGTCCTCCGATCGTTGTCAGAAGTAAGTTGGCCGCAGTGTTATCACTCATGGTTATGGCAGCAC

TGCATAATTCTCTTACTGTCATGCCATCCGTAAGATGCTTTTCTGTGACTGGTGAGTACTCAACCAAGTCATTCT

GAGAATAGTGTATGCGGCGACCGAGTTGCTCTTGCCCGGCGTCAATACGGGATAATACCGCGCCACATAGCAGAA

CTTTAAAAGTGCTCATCATTGGAAAACGTTCTTCGGGGCGAAAACTCTCAAGGATCTTACCGCTGTTGAGATCCA

GTTCGATGTAACCCACTCGTGCACCCAACTGATCTTCAGCATCTTTTACTTTCACCAGCGTTTCTGGGTGAGCAA

AAACAGGAAGGCAAAATGCCGCAAAAAAGGGAATAAGGGCGACACGGAAATGTTGAATACTCATACTCTTCCTTT

TTCAATATTATTGAAGCATTTATCAGGGTTATTGTCTCATGAGCGGATACATATTTGAATGTATTTAGAAAAATA

AACAAATAGGGGTTCCGCGCACATTTCCCCGAAAAGTGCCACCTGACGTCGACGGATCGGGAGATCGATCTCCCG

ATCCCCTAGGGTCTTACTCTCAGTACAATCTGCTCTGATGCCGCATAGTTAAGCCAGTATCTGCTCCCTGCTTGT

GTGTTGGAGGTCGCTGAGTAGTGCGCGAGCAAAATTTAAGCTACAACAAGGCAAGGCTTGACCGACAATTGCATG

AAGAATCTGCTTAGGGTTAGGCGTTTTGCGC

BE4-PpAPOBEC1

(SEQ ID NO: 437)

ATGACCTCTGAGAAGGGCCCTAGCACAGGCGACCCCACCCTGCGGCGGAGAATCGAGAGCTGGGAGTT

CGACGTGTTCTACGACCCTAGAGAACTGAGAAAGGAAACCTGCCTGCTGTACGAGATCAAGTGGGGCA

TGAGCAGAAAGATCTGGCGGAGCTCTGGCAAGAACACCACCAACCACGTGGAAGTGAATTTCATCAAG

AAGTTCACCAGCGAGAGAAGGTTCCACAGCAGCATCAGCTGCAGCATCACCTGGTTCCTGAGCTGGTC

CCCTTGCTGGGAATGCAGCCAGGCCATCAGAGAGTTCCTGAGCCAACACCCCGGAGTGACACTGGTGA

TCTACGTGGCCAGACTGTTCTGGCACATGGACCAGAGAAACAGACAGGGCCTGAGAGATCTGGTCAAC

AGCGGCGTGACTATCCAGATCATGCGGGCCAGCGAGTACTACCACTGTTGGCGGAACTTCGTGAACTA

CCCCCCCGGCGATGAGGCCCACTGGCCTCAGTACCCTCCTCTGTGGATGATGCTGTACGCCCTGGAAC

TGCACTGCATCATCCTGTCTCTGCCTCCATGTCTGAAGATCTCTAGAAGATGGCAGAACCACCTGGCC

TTCTTCAGACTGCACCTGCAGAATTGCCACTACCAGACCATCCCCCCCCACATCCTGCTGGCTACAGG

CCTGATCCACCCTTCTGTGACCTGGAGA

BE4-RrA3F (SEQ ID NO: 438)

ATGAAGCCCCAGATCAGGGACCACCGCCCCAATCCTATGGAGGCCATGTACCCTCACATCTTCTATTT

TCACTTCGAGAACCTGGAGAAGGCCTACGGCCGGAATGAGACCTGGCTGTGCTTTACAGTGGAGATCA

TCAAGCAGTATCTGCCAGTGCCCTGGAAGAAGGGCGTGTTCCGGAACCAGGTGGATCCAGAGACCCAC

TGCCACGCCGAGAAGTGTTTTCTGTCCTGGTTCTGTAACAATACACTGTCTCCCAAGAAGAATTACCA

GGTGACCTGGTATACAAGCTGGTCCCCTTGCCCAGAGTGTGCAGGAGAGGTGGCAGAGTTTCTGGCAG

AGCACAGCAACGTGAAGCTGACCATCTACACAGCCCGGCTGTACTATTTCTGGGACACCGATTATCAG

GAGGGCCTGAGATCTCTGAGCGAGGAGGGCGCCTCCGTGGAGATCATGGACTACGAGGATTTTCAGTA

TTGCTGGGAGAACTTCGTGTACGACGATGGCGAGCCTTTTAAGAGGTGGAAGGGCCTGAAGTATAATT

-continued

TCCAGTCTCTGACACGGAGACTGCGCGAGATCCTGCAG

BE4-AmAPOBEC1

(SEQ ID NO: 439)

ATGGCCGACAGCTCCGAGAAGATGAGGGGCCAGTACATCAGCCGCGACACCTTTGAGAAGAATTATAA

GCCCATCGATGGCACAAAGGAGGCCCACCTGCTGTGCGAGATCAAGTGGGGCAAGTACGGCAAGCCTT

GGCTGCACTGGTGTCAGAATCAGCGGATGAACATCCACGCCGAGGACTATTTCATGAACAATATCTTT

AAGGCCAAGAAGCACCCTGTGCACTGCTACGTGACCTGGTATCTGTCTTGGAGCCCATGCGCCGATTG

TGCCTCCAAGATCGTGAAGTTCCTGGAGGAGCGGCCCTACCTGAAGCTGACCATCTATGTGGCCCAGC

TGTACTATCACACAGAGGAGGAGAATAGGAAGGGCCTGCGGCTGCTGCGGAGCAAGAAAGTGATCATC

CGCGTGATGGACATCTCCGATTACAACTATTGCTGGAAGGTGTTCGTGTCTAACCAGAATGGCAACGA

GGACTACTGGCCACTGCAGTTTGATCCCTGGGTGAAGGAGAATTATTCTCGGCTGCTGGATATCTTCT

GGGAGTCCAAGTGTAGATCTCCCAACCCTTGG

BE4-SsAPOBEC2

(SEQ ID NO: 440)

ATGGACCCACAGAGGCTGCGCCAGTGGCCCGGCCCTGGCCCAGCAAGCAGGGGCGGCTACGGCCAGCG

GCCAAGAATCAGGAACCCCGAGGAGTGGTTTCACGAGCTGTCTCCCCGGACCTTCAGCTTTCACTTCC

GCAACCTGAGGTTCGCATCCGGCCGCAATCGGTCTTATATCTGCTGTCAGGTGGAGGGCAAGAACTGC

TTCTTTCAGGGCATCTTTCAGAATCAGGTGCCACCTGACCCACCATGCCACGCAGAGCTGTGCTTCCT

GTCTTGGTTCCAGAGCTGGGGCCTGTCCCCCGATGAGCACTACTATGTGACATGGTTTATCTCTTGGA

GCCCTTGCTGTGAGTGTGCCGCCAAGGTGGCCCAGTTCCTGGAGGAGAACCGCAACGTGAGCCTGTCT

CTGAGCGCCGCAAGGCTGTACTATTTCTGGAAGTCCGAGTCTAGAGAGGGACTGCGGAGACTGAGCGA

CCTGGGAGCACAAGTGGGAATCATGTCCTTTCAGGATTTCCAGCACTGCTGGAACAATTTTGTGCACA

ACCTGGGCATGCCCTTCCAGCCTTGGAAGAAGCTGCACAAGAATTACCAGAGGCTGGTGACCGAGCTG

AAGCAGATCCTGCGCGAGGAGCCTGCCACATATGGCTCTCCACAGGCCCAGGGCAAGGTGAGAATCGG

AAGCACCGCAGCAGGACTGAGGCACAGCCACTCCCACACACGCTCCGAGGCACACCTGAGGCCTAACC

ACAGCTCCAGACAGCACAGGATCCTGAATCCTCCACGGGAGGCCAGAGCCAGGACCTGCGTGCTGGTG

GATGCCTCTTGGATCTGTTACAGA

The Experiments described in Examples 2-5 describe the production of alternative, next-generation deaminases with reduced activity on exposed ssDNA, a feature that is especially important for the beneficial and effective therapeutic application of base editors.

Provided are new, next-generation CBEs with minimized un-guided RNA and DNA off-target editing that were identified by screening of a variety of sequence diverse cytidine deaminases. Two high-throughput assays were developed and utilized to evaluate unguided ssDNA editing efficiency. From a total of 153 deaminases screened, four enzymes, namely, PpAPOBEC1, RrA3F, AmAPOBEC1, and SsAPOBEC2, were identified and characterized as having reduced off-target editing and high on-target editing. Together with structure-guided mutagenesis on the four constructs, eight (8) next-generation CBEs-BE4-PpAPOBEC1, BE4-PpAPOBEC1 H122A, BE4-PpAPOBEC1 R33A, BE4-RrA3F, BE4-RrA3F F130L, BE4-AmAPOBEC1 and BE4-SsAPOBEC2 and BE4-SsAPOBEC2 R54Q-were identified with reduced to minimized off-target editing efficiency and on-target editing efficiency comparable to that of BE4 containing rAPOBEC1. Transcriptome-wide RNA deamination associated with expression of these editors was comparable to that of nCas9 (D10A)-2×UGI, while the average on-target editing was about 3.9- to 5.7-fold higher than that of BE4 with rAPOBEC1 with previous SECURE mutations (R33A, K34A), (Grunewald, J. et al., *Nature,* 569:433-437 (2019)).

As described collectively in Examples 2-5, to mitigate spurious off-target events, a sensitive, high-throughput cellular assay was developed and used to select next-generation CBEs that displayed reduced spurious deamination profiles relative to rAPOBEC1-based CBEs, while maintaining equivalent or superior on-target editing frequencies. 153 CBEs containing cytidine deaminase enzymes with diverse sequences were screened, and four new CBEs with the most promising on/off target ratios were identified. These spurious-deamination-minimized CBEs (BE4 with either RrA3F, AmAPOBEC1, SsAPOBEC2, or PpAPOBEC1) were further optimized for superior on- and off-target DNA editing profiles through structure-guided mutagenesis of the deaminase domain. These next-generation CBEs displayed comparable overall DNA on-target editing frequencies, while eliciting a 10- to 49-fold reduction in C-to-U edits in the transcriptome of treated cells, and up to a 33-fold overall reduction in unguided off-target DNA deamination relative to BE4 containing rAPOBEC1. Taken together, these next-generation CBEs represent new base editing products and agents for applications in which minimization of spurious deamination is desirable and high on-target activity is required.

The next-generation CBEs as described herein also showed ~2 to 9-fold reduction in editing efficiency on free ssDNA oligos in in vitro enzymatic assay. Such next-generation CBEs are useful for new targets of interest. In embodiments, BE4 containing PpAPOBEC1 H122A or BE4 containing RrA3F are provided as BEs having activities that are superior to that of BE4 with rAPOBEC1, as BE4 containing PpAPOBEC1 H122A or BE4 containing RrA3F are effective for minimizing spurious DNA and RNA deamination events associated with rAPOBEC1. The next-generation CBEs as described herein are superior to the canonical BE4 and are provided as highly useful and advantageous products for genome editing.

Example 6: Materials and Methods of the Above-Described Examples

General Methods:

Constructs used in the described Examples (Examples 2-5 collectively) were obtained by USER assembly, Gibson assembly, or purchased from Genscript. Gene fragments used for PCR were purchased as mammalian codon-optimized gene fragments from IDT. PCR was performed with primers obtained from IDT using either Phusion U DNA Polymerase Green MultiPlex PCR Master Mix (ThermoFisher) or Q5 Hot Start High-Fidelity 2× Master Mix (New England Biolabs). Endo-free plasmids used for mammalian transfection were prepared using ZymoPURE II Plasmid Midiprep (Zymo Research Corporation) from 50 mL Mach1 (ThermoFisher) culture. Sequences for CBEs, protospacer sequences for sgRNA, and oligos used in the Examples are presented hereinabove.

HEK293T Cell Culture:

HEK293T cells (CLBT×013, American Type Cell Culture Collection (ATCC)) were cultured in Dulbecco's Modified Eagles Medium plus Glutamax (10566-016, Thermo Fisher Scientific) with 10% (v/v) fetal bovine serum (A31606-02, Thermo Fisher Scientific). The cell culture incubator was set to 37° C. with 5% $CO_2$. Cells were tested negative for *mycoplasma* after receipt from supplier.

Transfection Conditions and gDNA Extraction for NGS Amplicon Sequencing:

HEK293T cells were seeded onto 96-well, Poly-D-Lysine-treated BioCoat tissue culture (TC) plates (Corning) at a density of 12,000 cells/well. Transfection of HEK293T cells was carried out 18-24 hours after seeding the cells in the TC plate wells. To each well of cells, 90 ng of base editor or control plasmid, 30 ng sgRNA plasmid and 1 μL Lipofectamine 2000 (ThermoFisher Scientific) were added. For in-trans editing experiments, cells were also treated with 60 ng nSaCas9 (D10A)-2×UGI plasmid. Following an ~64 hour incubation, the medium was aspirated and 50 μL QuickExtract™ DNA Extraction Solution (Lucigen) were added to each well. gDNA extraction was performed according to manufacturer's instructions.

Transfection Conditions for Studies Used in Whole Transcriptome RNA Extraction and Protein Quantification:

Hek293T cells were seeded onto 48-well, Poly-D-Lysine-treated BioCoat TC plates at a density of 35,000 cells/well. To each well of cells, 300 ng base editor or control plasmid, 100 ng sgRNA plasmid and 1.5 μL lipofectamine 2000 were added. For the in-trans assay, 200 ng nSaCas9 (D10A)-2× UGI plasmid was added to the mixture in the well. The transfection protocol used was as described above. For RNA extraction, 300 μL RTL plus buffer (RNasy Plus 96 kit, Qiagen) were added to each well. RIPA buffer (100 μL per well, ThermoFisher Scientific) was used to lyse the cells for protein quantification. For in vitro enzymatic assays, each well of cells was lysed with 100 μL M-per buffer (ThermoFisher Scientific).

Next Generation Sequencing (NGS) and Data Analysis for On-Target and Off-Target DNA Editing Genomic DNA samples were amplified and prepared for high throughput sequencing as reported by Gaudelli, N. M. et al. (*Nature,* 551:464-471 (2017)). Briefly, 2 μL of gDNA were added to a 25 μL PCR reaction containing Phusion U Green Multiplex PCR Master Mix and 0.5 μM of each forward and reverse primer. Following amplification, PCR products were barcoded using unique Illumina barcoding primer pairs. Barcoding reactions contained 0.5 μM of each Illumina forward and reverse primer, 1 μL of PCR mixture containing the amplified genomic site of interest, and Q5 Hot Start High-Fidelity 2× Master Mix in a total volume of 25 μL. All PCR conditions were carried out using standard and reported methods. Primers used for site-specific mammalian cell genomic DNA amplification are listed in Table 17.

NGS data were analyzed by performing four general steps: (1) Illumina demultiplexing, (2) read trimming and filtering, (3) alignment of all reads to the expected amplicon sequence, and (4) generation of alignment statistics and quantification of editing rates. Each step is described Example 5 (FIG. 30).

Analysis of RNA Off-Target Editing

Total RNA extraction was carried out using RNasy Plus 96 kit (Qiagen) according to the manufacturer's protocol. An extra on-column DNase I (RNase-Free DNase Set, Qiagen) digestion step was added before the washing step according to the manufacturer's instructions.

cDNA samples were generated from the isolated mRNA using SuperScript IV One-Step RT-PCR System (Thermo Fisher Scientific) according to the manufacturer's instructions. Next Genome Sequencing (NGS) for targeted RNA sequencing was performed using the same protocol as was used for DNA editing. For whole transcriptome sequencing, mRNA isolation was performed from 100 ng total RNA using NEBNext Poly (A) mRNA Magnetic Isolation Module (NEB). Exome sequencing library preparation was performed using NEBNext® Ultra™ II Directional RNA Library Prep Kit for Illumina according to the manufacturer's instructions. The optional $2^{nd}$ SPRI beads selection was performed to remove residue adaptor contamination. The libraries made were analyzed using fragment analyzer (Agilent) and sequencing was performed (Novogene on NovaSeq S4 flow cell).

In Vitro Enzymatic Assays

Cells were lysed in M-per buffer and determination of the concentration of Cas9 was carried out using an automated Ella assay on an Ella instrument (Protein Simple). An aliquot of 5 μL cell lysate or Cas9 standard solution was mixed with 45 μL sample, and the mixture was added to 48-digoxigenin cartridges. The concentration of Cas9 in the base editor complex was quantified using anti-Cas9 antibody (7A9-A3A, Novus Biologicals).

The protein concentration was adjusted to 0.2 nM (final concentration) and mixed with 1 μL oligo (oligo sequence included in Table 17) at 0.1 μM or 0.5 μM concentration in reaction buffer (20 mM Tris pH 7.5, 150 mM NaCl, 1 mM DTT, 10% glycerol) for the indicated amount of time. The assay was quenched by heat-inactivation at 95° C. for 3 minutes, and product formation was quantified using percentage of C to T conversion (NGS) and input amount of oligos.

Data Availability:

Core next-generation CBEs described herein are deposited on Addgene. High-throughput sequencing data is deposited in the NCBI Sequence Read Archive (PRJNA595157).

Code Accessibility:

All software tools used for data analysis are publicly available. Detailed information about versions and parameters used, as well as shell commands, are provided below.

Targeted NGS Analysis:

1. To generate FASTQ files from the base call files (BCF) generated by the MiSeq, demultiplexing was performed by running Illumina bcl2fastq (v2.20.0.422) with the following parameters:

```
bcl2fastq\
    ignore-missing-bcls\
    ignore-missing-filter\
    ignore-missing-positions \
    ignore-missing-controls\
    auto-set-to-zero-barcode-mismatches\
    find-adapters-with-sliding-window\
    adapter-stringency 0.9 \
    mask-short-adapter-reads 35 \
    minimum-trimmed-read-length 35 \
```

2. The FASTQ files created in step (1) were processed using trimmomatic (v0.39), (Bolger, A. M. et al., *Bioinformatics,* 30:2114-2120 (2014)), with parameters set up to clip Illumina TruSeq adapters, exclude reads shorter than 20 bases, and trim the remaining 3' end of reads if the average base quality (Phred score) in a 4-bp sliding window dropped below 15. In addition, any bases with quality scores of 3 or lower at the end of reads were removed. Finally, because the round 1 PCR primers include four randomized bases after the read 1 primer sequence, the first four bases of each read were trimmed. The command used to execute trimmomatic is shown below:

```
trimmomatic SE-phred33 $input_fastq $output_fastq\
    ILLUMINACLIP:illumine_adapters.fa:2:30:10\
    LEADING:3 TRAILING:3\
    SLIDINGWINDOW:4:15\
    MINLEN:20\
    HEADCROP:4
```

3. Reads were aligned to amplicon sequences using bowtie2 (v2.35), (Langmead, B. and Salzberg, S. L., *Nat Methods,* 9:357-359 (2012)), in end-to-end mode with the alignment parameters specified by the—very sensitive flag. Reference sequences were determined as the expected amplicon sequences (including primers) for each primer pair based on the human genome (GRCh38). The SAM files created by bowtie2 were converted to BAM files, sorted, and indexed using the samtools package (v1.9), (Li, H. et al., *Bioinformatics,* 25:2078-2079 (2009)). Only samples with at least 5,000 aligned reads were considered for analysis.

4. The BAM files created in step (3) were processed using the bam-readcounts tool (github.com/genome/bam-readcount) to generate plain text files summarizing the number of non-reference bases, deletions and insertions at each position in the alignment. The minimum base quality (Phred score) for counting a non-reference base was set to 29 to exclude low confidence base calls from statistics about editing rates. Only reads with insertions and/or deletions that overlapped the base editor target site (defined as its protospacer+PAM sequence) were counted towards insertion and deletion rates. Editing rates for each position in the target site were calculated as the fraction of non-reference bases of a given type (e.g., G) to the total number of bases passing the base quality threshold at a given position in the alignment.

Transcriptome Sequencing Analysis Method:

FASTQ files were downloaded from Novagene and aligned to the human genome (Gencode GRCh38v31) using STAR (v2.7.2a). Genome alignments were then duplicate-marked and sorted with Picard (v2.20.5). Reads that contain Ns in their cigar string because they span splicing junctions were split using GATK (v4.1.3.0), and then base quality score recalibration was performed with Picard. Variant calls were generated with GATK Haplotype Caller with standard settings for variant calling in RNA: minimum-mapping-quality 30, minimum-base-quality 20, dont-use-soft-clipped-bases, standard-call-conf 20.

To identify somatic mutations private to the base-editor treated samples as described herein, background filtration was performed using an nCas9 treated sample. Only substitutions on canonical chromosomes were considered. A mutation was determined to be private to the base-editor-treated sample if its genomic position had ≥30× coverage in the base-editor treated sample and ≥20× coverage in the nCas9 sample with 99% of reads containing the reference base.

Example 7: Evaluation of Genome Wide Spurious Deamination of C Base Eeditors

Figure 31:
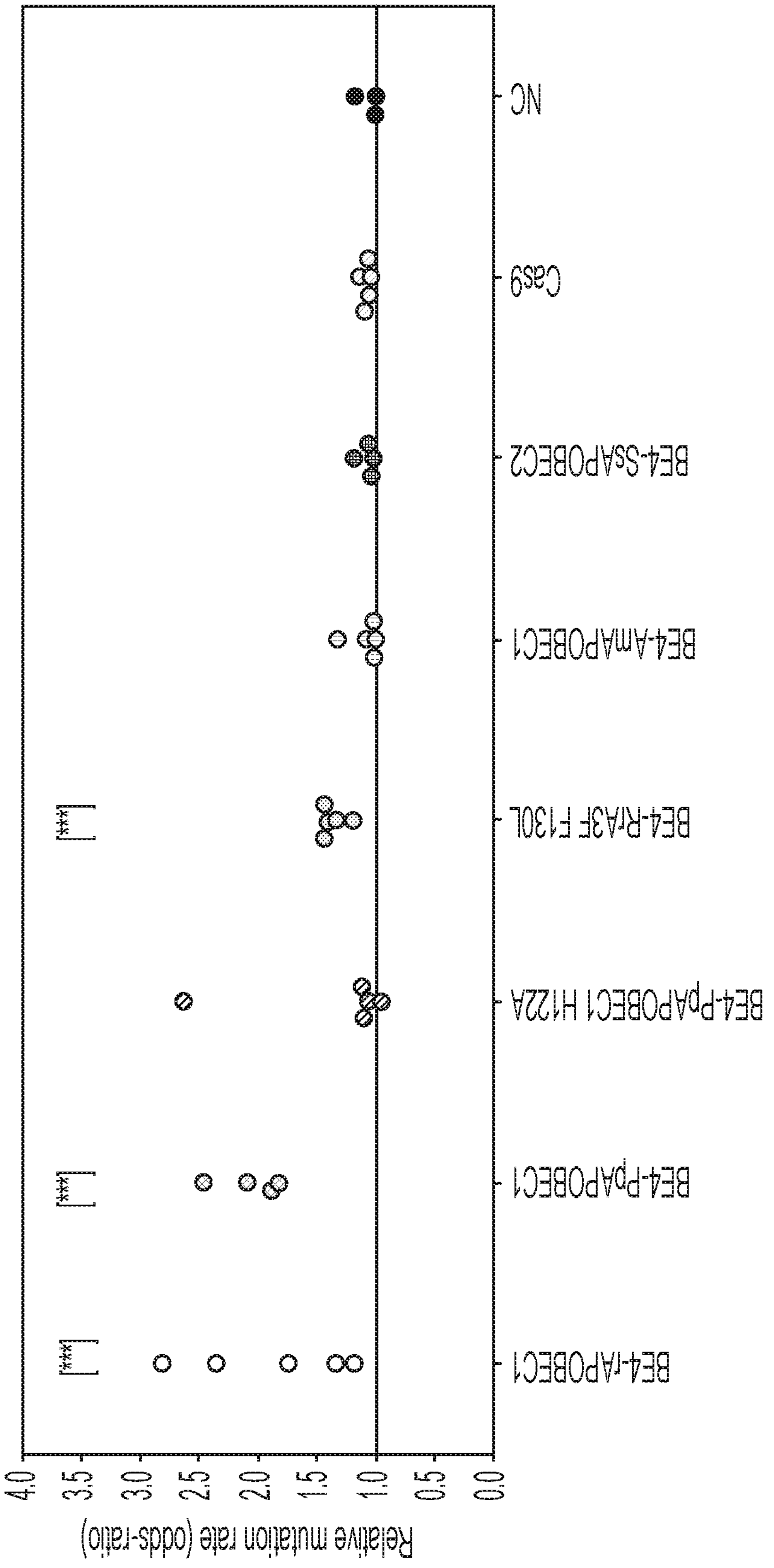
FIG. 31 presents a graph showing spurious deamination activity of CBEs examined by whole genome sequencing (WGS). Relative mutation rates are shown in odds-ratio.

Spurious deamination activities of the C-to-T base editors generated herein were examined by whole genome sequencing (WGS) of single cell expansions (FIG. 31, relative mutation rates shown in odds-ratio). Cells were transfected with mammalian expression plasmids encoding the base editors together with a plasmid expressing a guide RNA that targets the Beta-2 microglobulin (B2M) gene and disrupts its expression. After 5 days of incubation, the edited cells (B2M negative cells) were sorted as single cells by flow cytometry. Colonies expanded from the single cells were used for whole genome sequencing.

From whole genome sequencing (WGS) data, spurious C to T mutations were detected from samples treated with BE4-rAPOBEC1. Variant counts and edit rates at two positions (positions 4 and 6) in B2M, and actual p-valunes from MannU test of same are shown in Tables 18A and 18B below. No significant enrichment of C to T mutations were detected in samples treated with BE4-AmAPOBEC1 and BE4-SsAPOBEC2 (FIG. 31). Data also support reduction of spurious deamination in samples treated with BE4-PpAPOBEC1 H122A and BE4-RrA3F F130L compared those treated with BE4-rAPOBEC1 (FIG. 31). All Cas9 samples tested exhibit indels as expected.

TABLE 18A

| Variant counts and edit rates of deamination by CBEs: | | | | | | | |
|---|---|---|---|---|---|---|---|
| | | total | C -> T | fraction | fraction reads with C-T in B2M guide | | |
| sample_id | editor | mutations | mutation | C -> T | pos4 | pos6 | Indels |
| s9A | BE4-AmAPOBEC1 | 3013 | 382 | 0.1125 | 1 | 1 | |
| s5G | BE4-AmAPOBEC1 | 3487 | 448 | 0.1139 | 0.642857143 | 1 | |
| s5H | BE4-AmAPOBEC1 | 3526 | 451 | 0.1134 | 0.615384615 | 1 | |
| s8F | BE4-AmAPOBEC1 | 3526 | 477 | 0.1192 | 0.619047619 | 1 | |
| s8G | BE4-AmAPOBEC1 | 14250 | 2301 | 0.1390 | 0.619047619 | 1 | |
| s10F | BE4-PpAPOBEC1 | 4845 | 1012 | 0.1728 | 0.625 | 0.64 | |
| s7H | BE4-PpAPOBEC1 | 4854 | 1127 | 0.1884 | 1 | 1 | |
| s8B | BE4-PpAPOBEC1 | 5291 | 1389 | 0.2079 | 1 | 1 | |
| s7G | BE4-PpAPOBEC1 | 5937 | 1277 | 0.1770 | 1 | 1 | |
| s5F | BE4-PpAPOBEC1 H122A | 4020 | 537 | 0.1178 | 0.333333333 | 1 | |
| s8C | BE4-PpAPOBEC1 H122A | 5375 | 1484 | 0.2164 | 1 | 1 | |
| s8E | BE4-PpAPOBEC1 H122A | 4334 | 602 | 0.1220 | 1 | 1 | |
| s8D | BE4-PpAPOBEC1 H122A | 3703 | 506 | 0.1202 | 1 | 1 | |
| s5E | BE4-PpAPOBEC1 H122A | 2870 | 348 | 0.1081 | 1 | 1 | |
| s5D | BE4-rAPOBEC1 | 3170 | 463 | 0.1274 | 1 | 1 | |
| s5C | BE4-rAPOBEC1 | 4371 | 711 | 0.1399 | 1 | 1 | |
| s7E | BE4-rAPOBEC1 | 4407 | 888 | 0.1677 | 1 | 1 | |
| s7D | BE4-rAPOBEC1 | 5604 | 1425 | 0.2027 | 1 | 1 | |
| s7F | BE4-rAPOBEC1 | 7445 | 2156 | 0.2246 | 1 | 1 | |
| s9F | BE4-RrA3F F130L | 2968 | 511 | 0.1469 | 1 | 1 | |
| s6C | BE4-RrA3F F130L | 4048 | 686 | 0.1449 | 1 | 1 | |
| s9G | BE4-RrA3F F130L | 4677 | 803 | 0.1465 | 1 | 1 | |
| s6D | BE4-RrA3F F130L | 3845 | 567 | 0.1285 | 1 | 1 | |
| s9E | BE4-RrA3F F130L | 3674 | 594 | 0.1392 | 1 | 1 | |
| s6A | BE4-SsAPOBEC2 | 3902 | 510 | 0.1156 | 0.6 | 1 | |
| s9B | BE4-SsAPOBEC2 | 3982 | 582 | 0.1275 | # N/A | 1 | |
| s9D | BE4-SsAPOBEC2 | 4001 | 535 | 0.1179 | 0.527777778 | 1 | |
| s9C | BE4-SsAPOBEC2 | 4162 | 537 | 0.1143 | 0.533333333 | 0.5625 | |
| s5A | Cas9 | 3306 | 453 | 0.1205 | 0 | 0 | has indels |
| s7C | Cas9 | 3389 | 477 | 0.1234 | 0 | 0 | has indels |
| s7A | Cas9 | 3627 | 482 | 0.1173 | 0 | 0 | has indels |
| s7B | Cas9 | 3771 | 496 | 0.1162 | 0 | 0 | has indels |
| s5B | Cas9 | 3810 | 508 | 0.1176 | 0 | 0 | has indels |
| s6F | NC | 3158 | 457 | 0.1264 | 0 | 0 | |
| s6E | NC | 3448 | 436 | 0.1123 | 0 | 0 | |
| s10C | NC | 3595 | 457 | 0.1128 | 0 | 0 | |

TABLE 18B

| Actual p-values from MannU test: | | |
|---|---|---|
| treatment | pvalue | |
| BE4-rAPOBEC1 | 0.01844421 | *** |
| BE4-PpAPOBEC1 | 0.02591496 | *** |
| BE4-PpAPOBEC1 H122A | 0.38279724 | |
| BE4-RrA3F F130L | 0.01844421 | *** |
| BE4-AmAPOBEC1 | 0.27549249 | |
| BE4-SsAPOBEC2 | 0.18837956 | |
| Cas9 | 0.27549249 | |
| NC | 0.40973849 | |

Additional Sequences

In the following sequence, lower case denotes the kanamycin resistance promoter region, bold sequence indicates targeted inactivation portion (Q4* and W15*), the italicized sequence denotes the targeted inactive site of kanamycin resistance gene (D208N), and the underlined sequences denote the PAM sequences.

Inactivated Kanamycin Resistance Gene:

(SEQ ID NO: 441)

ccggaattgccagctggggcgccctctggtaaggttgggaagccctgca aagtaaactggatggctttcttgccgccaaggatctgatggcgcagggg atcaagatctgatcaagagacaggatgaggatcctttcgcATGATCGAA

TAAGATGGATTGCACGCAGGTTCTCCGGCCGCTTAGGTGGAGCGCCTAT

TCGGCTATGACTGGGCACAACAGACAATCGGCTGCTCTGATGCCGCCGT

GTTCCGGCTGTCAGCGCAGGGGCGCCCGGTTCTTTTTGTCAAGACCGAC

CTGTCCGGTGCCCTGAATGAACTGCAGGACGAGGCAGCGCGGCTATCGT

GGCTGGCCACGACGGGCGTTCCTTGCGCAGCTGTGCTCGACGTTGTCAC

TGAAGCGGGAAGGGACTGGCTGCTATTGGGCGAAGTGCCGGGGCAGGAT

CTCCTGTCATCTCACCTTGCTCCTGCCGAGAAAGTATCCATCATGGCTG

ATGCAATGCGGCGGCTGCATACGCTTGATCCGGCTACCTGCCCATTCGA

CCACCAAGCGAAACATCGCATCGAGCGAGCACGTACTCGGATGGAAGCC

-continued

```
GGTCTTGTCGATCAGGATGATCTGGACGAAGAGCATCAGGGGCTCGCGC

CAGCCGAACTGTTCGCCAGGCTCAAGGCGCGCATGCCCGACGGCGAGGA

TCTCGTCGTGACCCATGGCGATGCCTGCTTGCCGAATATCATGGTGGAA

AATGGCCGCTTTTCTGGATTCATTAACTGTGGCCGGCTGGGTGTGGCGG

ACCGCTATCAGGACATAGCGTTGGCTACCCGTGATATTGCTGAAGAGCT

TGGCGGCGAATGGGCTGACCGCTTCCTCGTGCTTTACGGTATCGCCGCT

CCCGATTCGCAGCGCATCGCCTTCTATCGCCTTCTTGACGAGTTCTTCT

AA
```

Other Embodiments

From the foregoing description, it will be apparent that variations and modifications may be made to the embodiments as described herein to adopt them to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

SEQUENCE LISTING (549 sequences)

SEQ ID NO: 1 - protein, 229 aa, Rattus norvegicus [sequence omitted]

SEQ ID NO: 2 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 3 - protein, 229 aa, Mesocricetus auratus
MSSETGPVVVDPTLRRRIEPHEFDAFFDQGELRKETCLLYEIRWGGRHNIWRHTGQNTSRHVEINFIEKFTSERYFYPSTRCSIVWFLSWSPCGECSKAITEFLSGHPNVTLFIYAARLYHHTDQRNRQGLRDLISRGVTIRIMTEQEYCYCWRNFVNYPPSNEVYWPRYPNLWMRLYALELYCIHLGLPPCLKIKRRHQYPLTFFRLNLQSCHYQRIPPHILWATGFI

SEQ ID NO: 4 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 5 - protein, 236 aa, Pongo pygmaeus
MTSEKGPSTGDPTLRRRIESWEFDVFYDPRELRKETCLLYEIKWGMSRKIWRSSGKNTTNHVEVNFIKKFTSERRFHSSISCSITWFLSWSPCWECSQAIREFLSQHPGVTLVIYVARLFWHMDQRNRQGLRDLVNSGVTIQIMRASEYYHCWRNFVNYPPGDEAHWPQYPPLWMMLYALELHCIILSLPPCLKISRRWQNHLAFFRLHLQNCHYQTIPPHILLATGLIHPSVTWR

SEQ ID NO: 6 - protein, 236 aa, Oryctolagus cuniculus
MASEKGPSNKDYTLRRRIEPWEFEVFFDPQELRKEACLLYEIKWGASSKTWRSSGKNTTNHVEVNFLEKLTSEGRLGPSTCCSITWFLSWSPCWECSMAIREFLSQHPGVTLIIFVARLFQHMDRRNRQGLKDLVTSGVTVRVMSVSEYCYCWENFVNYPPGKAAQWPRYPPRWMLMYALELYCIILGLPPCLKISRRHQKQLTFFSLTPQYCHYKMIPPYILLATGLLQPSVPWR

SEQ ID NO: 7 - protein, 235 aa, Monodelphis domestica
MNSKTGPSVGDATLRRRIKPWEFVAFFNPQELRKETCLLYEIKWGNQNIWRHSNQNTSQHAEINFMEKFTAERHFNSSVRCSITWFLSWSPCWECSKAIRKFLDHYPNVTLAIFISRLYWHMDQQHRQGLKELVHSGVTIQIMSYSEYHYCWRNFVDYPQGEEDYWPKYPYLWIMLYVLELHCIILGLPPCLKISGSHSNQLALFSLDLQDCHYQKIPYNVLVATGLVQPFVTWR

SEQ ID NO: 8 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 9 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 10 - protein, 224 aa, Pongo pygmaeus
MAQKEEAAAATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEELEIQDALKKLKEAGCKLRIMKPQDFEYVWQNFVEQEEGESKAFQPWEDIQENFLYYEEKLADILK

SEQ ID NO: 11 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 12 - protein, 440 aa, Mus musculus
MQPQRLGPRAGMGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYISVPSSSSSTLSNICLTKGLPETRFWVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 13 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 14 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 15 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 16 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 17 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 18 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 19 - protein, 367 aa, Homo sapiens
MEPIYEEYLANHGTIVKPYYWLSFSLDCSNCPYHIRTGEEARVSLTEFCQIFGFPYGTTFPQTKHLTFYELKTSSGSLVQKGHASSCTGNYIHPESMLFEMNGYLDSAIYNNDSIRHIILYSNNSPCNEANHCCISKMYNFLITYPGITLSIYFSQLYHTEMDFPASAWNREALRSLASLWPRVVLSPISGGIWHSVLHSFISGVSGSHVFQPILTGRALADRHNAYEINAITGVKPYFTDVLLQTKRNPNTKAQEALESYPLNNAFPGQFFQMPSGQLQPNLPPDLRAPVVFVLVPLRDLPPMHMGQNPNKPRNIVRHLNMPQMSFQETKDLGRLPTGRSVEIVEITEQFASSKEADEKKKKKGKK

SEQ ID NO: 20 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 21 - protein, 388 aa, Rattus norvegicus
MEPLYEEYLTHSGTIVKPYYWLSVSLNCTNCPYHIRTGEEARVPYTEFHQTFGFPWSTYPQTKHLTFYELRSSSGNLIQKGLASNCTGSHTHPESMLFERDGYLDSLIFHDSNIRHIILYSNNSPCDEANHCCISKMYNFLMNYPEVTLSVFFSQLYHTENQFPTSAWNREALRGLASLWPQVTLSAISGGIWQSILETFVSGISEGLTAVRPFTAGRTLTDRYNAYEINCITEVKPYFTDALHSWQKENQDQKVWAASENQPLHNTTPAQWQPDMSQDCRTPAVFMLVPYRDLPPIHVNPSPQKPRTVVRHLNTLQLSASKVKALRKSPSGRPVKKEEARKGSTRSQEANETNKSKWKKQTLFIKSNICHLLEREQKKIGILSSWSV

SEQ ID NO: 22 - protein, 363 aa, Macaca fascicularis
MEPTYEEYLANHGTIVKPYYWLSFSLDCSNCPYHIRTGEEARVSLTEFCQIFGFPYGTTYPQTKHLTFYELKTSSGSLVQKGHASSCTGNYIHPESMLFEMNGYLDSAIYNNDSIRHIILYCNNSPCNEANHCCISKVYNFLITYPGITLSIYFSQLYHTEMDFPASAWNREALRSLASLWPRVVLSPISGGIWHSVLHSFVSGVSGSHVFQPILTGRALTDRYNAYEINAITGVKPFFTDVLLHTKRNPNTKAQMALESYPLNNAFPGQSFQMTSGIPPDLRAPVVFVLLPLRDLPPMHMGQDPNKPRNIIRHLNMPQMSFQETKDLERLPTRRSVETVEITERFASSKQAEEKTKKKKGKK

SEQ ID NO: 23 - protein, 198 aa, Homo sapiens [sequence omitted]

SEQ ID NO: 24 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 25 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 26 - protein, 198 aa, Mus musculus [sequence omitted]

SEQ ID NO: 27 - protein, 224 aa, Petromyzon marinus
MAGYECVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLTMHFSRIYDRDREGDHRGLRGLKHVSNSFRMGVVGRAEVKECLAEYVEASRRTLTWLDTTESMAAKMRRKLFCILVRCAGMRESGIPLHLFTLQTPLLSGRVVWWRV

SEQ ID NO: 28 - protein, 331 aa, Petromyzon marinus
MELREVVDCALASCVRHEPLSRVAFLRCFAAPSQKPRGTVILFYVEGAGRGVTGGHAVNYNKQGTSIHAEVLLLSAVRAALLRRRRCEDGEEATRGCTLHCYSTYSPCRDCVEYIQEFGASTGVRVVIHCCRLYELDVNRRRSEAEGVLRSLSRLGRDFRLMGPRDAIALLLGGRLANTADGESGASGNAWVTETNVVEPLVDMTGFGDEDLHAQVQRNKQIREAYANYASAVSLMLGELHVDPDKFPFLAEFLAQTSVEPSGTPRETRGRPRGASSRGPEIGRQRPADFERALGAYGLFLHPRIVSREADREEIKRDLIVVMRKHNYQGP

SEQ ID NO: 29 - protein, 209 aa, Petromyzon marinus
MAGDENVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLMMHFSRIYDRDREGDHRGLRGLKHVSNSFRMGVVGRAEVKECLAEYVEASRRTLTWLDTTESMAAKMRRKLFCILVRCAGMRESGMPLHLFT

SEQ ID NO: 30 - protein, 158 aa, Saccharomyces cerevisiae
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 31 - protein, 555 aa, Equus caballus
MPRGRARERQRRNPMEKLDAEAFSFHFLNMEFVYDRNCSYLCYQVEGRLSGSPVLSEQGVFPNEVCGKTRRHAELCFLDWFRGRLSPDEYYCVTWFISWSPCSNCAREVAEFLKRHRNVELSIFAARLYYCRDHEQGLQSLCNRGAQLAVMLRKDFTYCWDNFVHNSGREFSPWENIDANSDLLARKLEDLLKNPMEKLHRKTFSFHFRNLKFAKGRKCSYLCYRVEGRLSGSPGLSEQGVFLNEVCDENCRHAELCFLHWFRGRLSPHADYRVTWFISWSPCSNCAREVAEFLKQHRNVELHISAARLYYWQRNKPGLRNLRSSGAQLAIMFFWDFRDCWDNFVHNSGRHFIPWKKINVNSRLLATKLEDLLKNPLEKLHPNTFSFHFCNLEFAYDRKYSYLCYQVEGRLSGSPGLSEQGVFLNEVCGKTRCHAELCFLDWFRVRLSPDEYYRVTWFISWSPCFYCAREVADFLKQYRNVKLSIFAARLYYCRDHAQGLRSLCSSGAQLAIMFFWDFRYCWDNFVHNSGREFRPWKKINVNSRLLATKLEDILK

SEQ ID NO: 32 - protein, 437 aa, Panthera tigris
MEPWRPSPRNPMDRIDPKTFRFQFPNLRYASGRKLCYLCFQVERDYFYYNDSDWGVFRNEVHPWAPCHAEQCFLSWFRDQYPYRDEDYNVTWFLSWSPCPTCAEEVVEFLEEYRNLTLSIFTSRLYYFWHPNYQEGLCKLWDAGVQLDIMSCDEFEYCWDNFVYHKGMRFQRRNLLKDYDFLAAKLQEILSPGQQRKRDWPFPPRPGAQVDPRSWVQEVTEPGINTRRHPLHLLVSFLLPRPTMNPLQEDIFYRQFGNQHRVPKPYYYRRKTYLCYQLKLPEGTLIDKDCLRNKKKRHAEICFIDKIKSLTRDTSQRFEIICYITWSPCPFCAEELVAFVKDNPHLSLRIFASRLYVHWRWKYQQGLRHLHASGIPVAVMSLPEFEDCWRNFVDHQDRLFQPWRNLDQYSESIKRRLGKILTPLNDLRNDFRNLKLE

SEQ ID NO: 33 - protein, 440 aa, Tarsius syrichta
MPMKRMYSNIYFDHFNNQRLLSGQNAPWLCFKVERVENCMLVPLETGVFGNQVSGCCGKTERPVEPTSLTRSVLVSPNPGTELRAQQPSRKGHLGKLGCVEYPSPGLALVMLGYGASTYCPDSSMYCPETCHHPEMCFLYWFEKTLSHEEQYQITWYVSWSPCVNCAEEVAEFLSVHPKVNLTIYAARLYCYQKLNHRQGLRRLCKEGACVKIMNYEEFDHCWENFVYNNYKSFKPWVKLQDNYELLATELDKILRIPMERMPQKKFRFHFQNLIAKDRNTTWLCFEVKNVRKKHPPDLLERGIFQNQVTPRINCHAEMCFLSWFLENMLLHGKRYQVTWYISWSPCSICAEEVAEFLSAHPKVSLTIYAARLYYFWVPGYRQGLRRLVEEGARVEIMNYEEFDYCWENFVSINNEPFQPWEGLHEKYGYLVTKLNNILG

SEQ ID NO: 34 - protein, 453 aa, Tarsius syrichta
MEDNPEPRPRQQMDQDTFIFNFNNDPSVRGRHQTFLCYEVEHLDDDTWVPQDKYLGFLHNQPQSRSNAYCAYHAELCFLELVSSWQLDPAQRYRVTCFISWSPCSSCAQEVAAFLKKNRHVTLRILAARIYDYYQGYEDGLRTLQGVGVDITVMTSAEFGHCWNTFVDHQGSPFQPWEGLDQHSQVIWQRMQDILQVIPAKYLMEKVKYTVTVDILFKGRVPGPRYLMDQNTFTRNFINNLSVSGRRQTLLCYEVERLGGDIWVPLDQLRGFLLSQARDVLNYYQGRHAEPCFLDLVSSWQLDPAQHYRVTWFISWSPCTSCAQAVAAFLRENRHVTLRILAARIYDYHQGYEEGLRTLQRTGAHIDIMTFKEFGHCWNTFVNHKGSPFKSWTGLDQHSQALRKRLQDILHTMASSLWDQSEPKKPIPSQEVTLPESIPPSHGNRFRLVKRPS

SEQ ID NO: 35 - protein, 424 aa, Heterocephalus glaber
FCFLSCVHRKPIERIYKKAFRFYFRNLRCAYGRNKTFLCYEVKRERDNKVLHKGVVLNQVEPYMPLHAELRFLSWFHDTLLCPLGSYQVTLYVSWSPCSECAEELTTFLAGHRNVTMTIYVAQLYYCNWKSPNREGLKILIAEDARLRVMFYDEFLYCWRNFVKNDYNNFDPWSLLDENSRYHNRILQNILKGWGRPHRVGPEGEQTATPGGSGGHCISVFSLLRRREMTLKEETFRVQFNNAYKAPKPYRRRVTYLCYQLQEANGDPLTKGCLRTKKGYHAESRFIKRICSMDLGQDQSYQVTCFLTWSPCPHCAQELVSFKRAHPHLRLQIFTARLFFHWKRSYQEGLQRLCRAQVPVAVMGHPEFAYCWDNFVDHQPGPFEPPWAKLEYYSSCLKRRLQQILRSWGVDDLTNDFRNLQLGP

SEQ ID NO: 36 - protein, 385 aa, Trichechus manatus
MLSSPQTPGTRKPMKTLAPDEFSFNFENLRLAHGRNTTFLCFQVETKAPPSLNSPDSGIFQNQDHCPSHHHAEMVFLTWFQKRLSPAQHYEVTWYMSWSPCSRCAVQVAKFLKSNSTVNLSIFVARLYYPRELETKDGLHSLWQAGAQVQIMFFQDFKYCWENFVNNEGKPFQPWKNLDENSKDWDTELKDIHRNTTDLLTEEMFYSQFYNREKKSSIPRKTYLCYQLNEPQPVKRCLHYKKGYHAVTRFIDGIVSMNLDPARSYDITCYFTWSPCNRYARKLVSFIEDYPNLRLKVYTSRLYFHWCWTNMQGLQHLQNSRVTVAVMTFRDFEYCWKNFVDNQGKPFEPWEKLDLYSQSTERRLRRILKPLTPDVLNEDFGNLHL

SEQ ID NO: 37 - protein, 381 aa, Otolemur garnettii
LSCAFRDPMNRMYPKTFCQNFEKEPCPSNQNSSWLCFEVETKNSAVFFHRGVFRNQPAPPPRAPTSVLLSQGPVKTPCHAEECFLTWIQGVLPPDHHYHVTWYVSRGPCANCANLIVHFLAMHRRVTLTIFAAHLNFFWESDFQQGLLRMDQEGVQLHIMGYEEFEYCWDNFVYNQRKQFVPWNGLNENYEFMVSTLEDILRSPLDRIRQKDFSIHFRNSLWLDDKSTWLCFEVKRTKSPVPLYRGVFRNQSPPKTPCHAEVRFFTWLQDLPPDFCCQFTWYLSWSPCADCADLVANFLAKHRNVSLTIFVARLYYYRDPEMHRGLRRMYQEGANVDIMSVIEFEYCWDNFVYNQGKQFVPWNGLNENYEFLVPRLQEILE

SEQ ID NO: 38 - protein, 337 aa, Hirundo rustica
MYISKKALRRHFDPRVYPRETYLLCELQWEGSRRVWIHWIRNVPDHHAEEYFLEEVFEPRNYGFCNITLYLSWSPCCTCCSKIRDFLKRNPNVKIDIRVARLIYPDYAETRSSLRELNGLQRVSIQVMEAAGLSCIESKNHRISQVERDPKGSSSPTLFTLQDHLKLSNMTESVIQDSVSIQICYQMRILGFQCHIRWKLQPEDFQRNYSPNQIGRVVYLLYEVRWRRGSIWRNWCSNNPEQHAEVNFLENHFHHRPQTPCSITWFLSTSPCGKCSRRILEFLKSQPNVTLEIYAAKLFRHHDIRNRQGLRNLMMNGVTIYIMNLEGNPASLCLSVD

SEQ ID NO: 39 - protein, 237 aa, Gulo gulo
MSFEDYEYCWETFVDHKGMYFQSWDLLRDNDLLAAELKNILRSTMNPLRQEIFYHQFGNQPRAPRPYHRRKTYLCYQLQPHEGPITARVCLQNKKKRHAEIRFIDNIRALRLDRSQTFEITCYLTWSPCPTCAKALAVFVQDHPHISLRLFASRLFIHWCWKYQEGLRLLHRSRIPVAVMRLQEFEDCWRNFVDNQDEPFQPWNKLEQYSESITRRLRRILGHPQNNLENDFRNLHI

SEQ ID NO: 40 - protein, 221 aa, Heterocephalus glaber
RRRIEPWQFEASFDPRQLRRETCLLSEVRWGTSPRAWRGCSLNTARHAEVSFMDRLTSEGRLRGPVRCSITWFLSWSPCGACAQAIGEFLRQHPNVSLVIYIARLFWHVDEQNRQGLRDLVTRGVRMQVMSDPEFAHCWRNFVNYSPGQEARWPQVPPVWTWLYSLELHCILLNLPPCLKISRRHHNQLTFFQLILQNCHYQAIPSPVLLASGLIHPFVTW

SEQ ID NO: 41 - protein, 211 aa, Oryzias latipes
MITKLDSVLLPKKKFIYHYKNMRWARGRHETYLCFVVKRRVGPESLSFDFGHLRNRNGCHVELLFLRHLSALCPGLWGYGATGQGRVSYSITWFCSWSPCANCSFRLAQFLSQTPNLRLRIFVSRLYFCDLEDSREREGLRMLKKVGVHITVMSYKDYFYCWQTFVARKQSKFKPWDGLHQNSVRLSRKLNRILQPCETEDFRDAFKLLGL

SEQ ID NO: 42 - protein, 353 aa, Otolemur garnettii
MYLKTFYRHFNNRPYLSRRNDTWLCFEVKTTSSNSPGSFYSGVFRNQGPRYCPWHTELCFLTWVRPIVSHHHFYQITWYMSWSPCANCAWQVATFLATHENVSLTNYTVRIYYFWRQDYRQGLLRMIEEGTQVYVMSSKEFQHCWENFVDHWGTRWVTCWNRLKKNYEFLVTRLSEILSDPKERISPNTFYNQFNNTPVPRGRKDTWLCFEVKEKNSNSPGSFHRGVFQNQVFSGTSSHARRCPPDHHYEVTWYTSWSPCAHCAWHVVNFLTSNPNVSLTIFAARLYYIYRPEIQQGLRRVFQEGAKVHIMSLKEFKYCWAKLVYNSGMRFMPWYQFNFNFLFPNTTLKGDLH

SEQ ID NO: 43 - protein, 189 aa, Hippocampus comes
MDVHFMNFIYHYKNMRWAKGRNETYLCFVVKRRVGPNSLTFDFGHLRNRNGCHVELLFLRYLGRRLSYSITWFCSWSPCANCSAALSQFLSRMPNLRLRIFVARLYFCDMEDSHEREGLRLLQKAGVQVTVMSYKDYYYCWQTFVDRKKSHFKAWEDLHQNSVRLSRKLNRILQPCEMDLRDAFKLLGL

SEQ ID NO: 44 - protein, 194 aa, Rhinopithecus roxellana
MKPQIRDHRPNPMEAMYPHIFYFHFENLEKAYGRNETWLCFTVEIIKQYLPVPWKKGVFRNQVDPETHCHAEKCFLSWFCNNTLSPKKNYQVTWYTSWSPCPECAGEVAEFLAEHSNVKLTIYTARLYYFWDTDYQEGLRSLSEEGASVEIMDYEDFQYCWENFVYDDGEPFKRWKGLKYNFQSLTRRLREILQ

SEQ ID NO: 45 - protein, 190 aa, Rhinopithecus roxellana
MNPHIRNPMEAMYPGTFYFHFKNLWEADNRNESWLCFAVEVIKHHSTVSWKRGVFRNQVDPETHCHAEKCFLSWFCDNTLSPKKNYQVTWYTSWSPCPECAREVAKFLARHSNVMLTIYTARLYYSQYPNYQEGLRRLNEEGVPVEIMDYEDFKYCWENFVYNGDELFKPWKGLKYNFLFLDSKLQEILE

SEQ ID NO: 46 - protein, 202 aa, Homo sapiens
MNPQIRNPMERMYRDTFYDNFENEPILYGRSYTWLCYEVKIKRGRSNLLWDTGVFRGPVLPKRQSNHRQEVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 47 - protein, 202 aa, Cercopithecus neglectus
MDGSPASRPGHVMDPGTFTSNFNNKPWVSGQRETYLCYKVERSHNDTWVLLNQHRGFLRNQAKNRLHGDYGCHAELCFLGEVPSWRLDPTQTYRVTWFISWSPCFSGGCAEQVRAFLQENTHVRLRIFAARIYDYDFLYQEALRTLRDAGAQVSIMTYEEFKHCWDTFVDHQGRPFQPWDGLDEHSQALSGRLQAILQNQGN

SEQ ID NO: 48 - protein, 181 aa, Symphalangus syndactylus
MALLTAKTFRLQFNNKRRVTKPYYPRKALLCYQLTPQNGSTPTRGYFKNKKKRHAEIRFINKIKSMGLDETQCYQVTCYLTWSPCPSCAWELVDFIKAHDHLNLGIFASRLYYHWCRHQQEGLRLLCGSQVPVEVMGFPEFADCWENFVDHEEPLSFNPSEMLEELDKNSRAIKRRLEKIK

SEQ ID NO: 49 - protein, 211 aa, Pygocentrus nattereri
MDNTNRRKFIYHYKNVRWARGRHETYLCFVVKKRNSPDSLSFDFGHLRNRNGCHVELLFLRYIEVLCPGLWGSGVDGVRVSYAVTWFCSWSPCSNCAQRLTNFLSQTPNLRLRIFVARLYFCDEEDSLEREGLRHLQRAGVQITVMTYKDFFYCWQTFVASRERCFKAWEGLRQNSVRLSRKLNRILQVFISTPVISPLITTHLGQSWAGG

SEQ ID NO: 50 - protein, 315 aa, Poecilia formosa
RKVSYSVTWFCSWSPCANCSIRLAQFLHQTPNLRLRIFVSRLYFCDLEDSREREGLRILKKAGVHITVMSYKDYFYCWQTFVAKSQSKFKPWDGLHQNYIRLSRKLNRILQPALDIKKFIYHYKNLRWARGRCETYLCFVVKKKLHLFMFVIVGRNRLFDLNVTMNNKSLYLIPLHLQLLFLRHLGALCPGLWGYGVTGERKVSYSVTWFCSWSPCANCSIRLAQFLHQTPNLRLRIFVSRLYFCDLEDSREREGLRILKKAGVHITVMSYKDYFYCWQTFVAKSQSKFKPWDGLHQNYIRLSRKLNRILQVQFF

SEQ ID NO: 51 - protein, 189 aa, Neophocaena asiaeorientalis
MASDRGPSAGDATSRRRIEPWEFEVSFDPRELCKETRLLYEIKWGRSQHVWRHSGKNTTNHVECNFIEKFTSERPFHRSVSCCITWFLSWSPCWECSKAIREFLNQHPRVTLFIYVARLFQHMDPQNRQGLRDLIHSGVTIQIMGPTEYDYCWRNFVNYPPGKEAHWPRYPPPLMKLYALELHCIILVP

SEQ ID NO: 52 - protein, 180 aa, Mus minutoides
RNLISRETFNFNFENLCYAKGRKNTFLCYEVTRKDCDSPVSLCHGVFKNKGSIHAEICFLYWFHDKVLKVLTPREEFKVTWYMSWSPCFECAEQVVRFLATHHNLNLTIFSSRLYNVSDPDTQQKLCRLVQEGAQVAVMDLSEFKKCWEKFVDNDGQQFRPWKRLRTNFRYQNSKLQEIL

SEQ ID NO: 53 - protein, 221 aa, Cebus capucinus
MWEAQSPGLSREWGSVAISPEDPGPLHIGRFLSCAFRHPMNAMYPGIFNFHFRNLRKAYGRNETWLCFTVEGIMNRSTVSWKSGVFRNQVGSDPFCHAEMCFLSWFRHNMLSPKKDYEVTWYASWSPCPECAGQVAEFLARHGNVRLTIFTAHLYYFWNPSFRQGLRRLSQEGASVLIMGYEDFEYCWDNFVYNDGQPFKPWKRLQDNSLSLYITLQEILQ

SEQ ID NO: 54 - protein, 206 aa, Cebus capucinus
MEASPASRPRPLMGPRTFTENFTNNPEVFGRHQTYLCYEVKCQGPDGTRDLMTEQRDFLCNQARNLLSGFDGRHAERCFLDRVPSWRLDPAQTYRVTCFISWSPCFSCAREVAEFLQENPHVNLRIFAARIYDCRPRYEEGLQMLQNAGAQVSIMTSEEFRHCWDTFVDHQGHPFQPWEGLDEHSQALSRRLQAILQGNRWMILSL

SEQ ID NO: 55 - protein, 184 aa, Cercocebus atys
NPMKAMDPHIFYFHFKNLRKAYGRNETWLCFAVEIIKQRSTVPWRTGVFRNQVDPESHCHAERCFLSWFCEDILSPNTDYRVTWYTSWSPCLDCAGEVAEFLARHSNVELAIFAARLYYFWDTHYQQGLRSLSEKGASVEIMGYEDFKYCRENFVCDDGKPFKPWKGLKTNFRFLKRRLQEILE

SEQ ID NO: 56 - protein, 197 aa, Pteropus alecto
MHLQVWRKVTEAWREGYTLKPWSRNPMERLYHDYFYFHFYNLPTPKHRNGCYICYQVEGTKKHSRMPLLRGVFENQESLDMMLSPGEKYRVTWYISWSPCFACVDEVIKFLREHTNVELIIFAARLYHSDILQYRQGLRKLHDAGVHVAIMSYYEFKHCLNDFVFHQGRSFCPWNDLNKNSKNLSNTLEDILRNQED

SEQ ID NO: 57 - protein, 206 aa, Ovis aries
MTEGWAGSGLPGRGDCVWTPQTRNTMNLLRETLFKQQFGNQPRVPPPYYRRKTYLCYQLKELDDLMLDKGCFRNKKQRHAEIRFIDKINSLNLNPSQSYKIICYITWSPCPNCASELVDFITRNDHLNLQIFASRLYFHWIKPFCRGLHQLQKAGISVAVMTHTEFEDCWEQFVDNQLRPFQPWDKLEQYSASIRRRLQRILTAPT

SEQ ID NO: 58 - protein, 205 aa, Pteropus alecto
MAGLGQACEGCCGQMPEISYPMGRLDPKTFSFEFKNLPYAYGRKSSYLCFQVEREQHSSPVPSDWGVFKNQFCGTEPYHAELCFLNWFRAEKLSPYEHYDVTWFLSWSPCSTCAEEIAIFLSNHKNVRLNIFVSRIYYFWKPAFRQGLQELDHLGVQLDAMSFDEFKYCWENFVDNQGMPFRCWKKVHQNYKSVLRKLNEILRRR

SEQ ID NO: 59 - protein, 309 aa, Myotis lucifugus
YAELSFLDLFQSWNLDRGRQYRLTWYMSWSPYPDCAQKLVEFLGENSHVTLRIFAADIHSLCSGYEDGLRKLRDARAQLAIMTRDELQYCWVTFVDNQGQPFRPWPNLVEHIKTKKQELKDILGNPMRRMYPKTFNFNFQNLNSYGRKSTFLCFEVETWEDGSVLDYQNGVFQNQLDPGHAELCFIEWFHEKVLFPDEVRCPDAQYHVTWYISWSPCFECAEQVAGFLNEHENVDLSISAARLYLCEDEDEQGLQDLVAAGAKVAMMAPEDFEYCWDNFVYNRGWPFTYWKHVRRNYGRLQEKLDEILW

SEQ ID NO: 60 - protein, 216 aa, Erinaceus europaeus
RRIEPWEFEDFFDPRQFRPETCLLYEVRWGSSRNAWRSTARNTTRHAEVNFLERFAAERHFDKPVSCSITWFLSWSPCWECSQAIGAFLSQHPQVTLAIHVTRLFHHEDEQNRQGLRDLLARGVTLQVMGDSEYAHCWRTFVNSPPGAEGHYPRYPSDFTRLYALELHCIILGLPPCLEILRRYQNQFTLFRLVPQNCHYQMIPHLNFFVVRHYFF

SEQ ID NO: 61 - protein, 192 aa, Alligator mississippiensis
MADSSEKMRGQYISRDTFEKNYKPIDGTKEAHLLCEIKWGKYGKPWLHWCQNQRMNIHAEDYFMNNIFKAKKHPVHCYVTWYLSWSPCADCASKIVKFLEERPYLKLTIYVAQLYYHTEEENRKGLRLLRSKKVIIRVMDISDYNYCWKVFVSNQNGNEDYWPLQFDPWVKENYSRLLDIFWESKCRSPNPW

SEQ ID NO: 62 - protein, 201 aa, Xenopus laevis
MTMDSMLLKRNKFIYHYKNLRWARGRHETYLCYIVKRRYSSVSCALDFGYLRNRNGCHAEMLFLRYLSIWVGHDPHRNYRVTWFSSWSPCYDCAKRTLEFLKGHPNFSLRIFSARLYFCEERNAEPEGLRKLQKAGVRLSVMSYKDYFYCWNTFVETRESGFEAWDGLHENSVRLARKLRRILQPPYDMEDLREVFVLLGL

SEQ ID NO: 63 - protein, 191 aa, Canis lupus
MNPLQEETFYQQFSNQRVPKPTYQRRTYLCYQLKPHEGSVIAKVCLQNQEKRHAEICFIDDIKSRQLDPSQKFEITCYVTWSPCPTCAKKLIAFVNDHPHISLRLFASRLYFHWRQKYKRELRHLQKSGIPLAVMSYLEFKDCWEKFVDHKGRPFQPWNKLKQYSESIGRRLQRILQPLNNLENDFRNLRL

SEQ ID NO: 64 - protein, 226 aa, Ailuropoda melanoleuca
SSAAPASIHLLDEDTFTENFRNDDWPSRTYLCYKVEGPDQGSGVPLGQDKGILHNKPAQGPEPSRHAECYLLEQIQSWNLDPKLHYGVTCFLSWSPCAKCAQKMARFLQENSHVSLKLFASRLYTRERWDEDYKEGLRTLKRAGASIAIMTYREFEHCWKTFVLHDQEGSCFQPWPFLHKESQKFSEKLQAILQVGVLLLSLPPPLPSSPLSSPWPFPAPLRASTG

SEQ ID NO: 65 - protein, 238 aa, Alligator sinensis
MGEHWQYAGSGEYIPQDQFEENFDPSVLLAETHLLSELTWGGRPYKHWYENTEHCHAEIHFLENFSSKNRSCTITWYLSWSPCAECSARIADFMQENTNVKLNIHVARLYLHDDEHTRQGLRYLMKMKRVTIQVMTIPDYTYCWNTFLEDDGEDESDDYGGYAGVHEDEDESDDDDYLPTHFAPWIMLYSLELSCILQGFAPCLKIIQGNHMSPTFQLHVQDQEQKRLLEPANPWGAD

SEQ ID NO: 66 - protein, 220 aa, Pteropus vampyrus
MPRIGNMNLLSEKTFNYHFGNQLRVKKPQGRRRTYLCYKLKLPNETLVKGYFINKKKNHAEIRFINKIRSLNLDQTQSYKITCYITWSPCSYCAGKLVALVKSCPHLSLQIFTSRLYYHWLWKNQAGLRYLWKINISVLVMKEPEFADCWDNFVNHQSRRFKPWEKLTQYSNSTERRLLRILRINRTDLFLAQSSEQDPGLNDLVDAIKRLFLDAHRPRD

SEQ ID NO: 67 - protein, 198 aa, Alligator mississippiensis
MAVEEEKGLLGTSQGWKIELKDFQENYMPSTWPKVTHLLYEIRWGKGSKVWRNWCSNTLTQHAEVNCLENAFGKLQFNPPVPCHITWFLSWSPCCQCCRRILQFLRAHSHITLVIKAAQLFKHMDERNRQGLRDLVQSGVHVQVMDLPDYRYCWRTFVSHPHEGEGDFWPWFFPLWITFYTLELQHILLQQHALSYNL

SEQ ID NO: 68 - protein, 158 aa, Rhinopithecus bieti
IWLCFTMEIIKQCSTVSWKRGVFRNQVDPETHCHAERCFLSWFWEDTLSPNTNYQVTWYTSWSPCLDCAGEVAEFLARHSNVKLAIFAARLYYFWDTDYQQGLRSLSEEGTSVEIMGYEDFKYCWENFVYNGDEPFKPWKGLKYNFLFLDSKLQEILE

SEQ ID NO: 69 - protein, 280 aa, Sus scrofa
MDPQRLRQWPGPGPASRGGYGQRPRIRNPEEWFHELSPRTFSFHFRNLRFASGRNRSYICCQVEGKNCFFQGIFQNQVPPDPPCHAELCFLSWFQSWGLSPDEHYYVTWFISWSPCCECAAKVAQFLEENRNVSLSLSAARLYYFWKSESREGLRRLSDLGAQVGIMSFQDFQHCWNNFVHNLGMPFQPWKKLHKNYQRLVTELKQILREEPATYGSPQAQGKVRIGSTAAGLRHSHSHTRSEAHLRPNHSSRQHRILNPPREARARTCVLVDASWICYR

SEQ ID NO: 70 - protein, 182 aa, Anolis carolinensis
KAAILLSNLFFRWQMEPEAFQRNFDPREFPECTLLLYEIHWDNNTSRNWCTNKPGLHAEENFLQIFNEKIDIKQDTPCSITWFLSWSPCYPCSQAIIKFLEAHPNVSLEIKAARLYMHQIDCNKEGLRNLGRNRVSIMNLPDYRHCWTTFVVPRGANEDYWPQDFLPAITNYSRELDSILQD

SEQ ID NO: 71 - protein, 230 aa, Equus caballus
MDPQAPTQRGGLGQAYQGGDYVQAPGNGNTQHLLSEDVFKKQFGNQRRVTKPYYRRKTYVCYQLKLLRGPTIAKGYFRNKKKRHAEIRFIDKINSLGLDQDQSYEITCYVTWSPCATCACKLIKFTRKFPNLSLRIFVSRLYYHWFRQNQQGLRQLWASSIPVVVMGYQEFADCWENFADNRGNPFQSWEKLTEYSKGIKRRLQKILEPLNLNGLEDAMGNLKLGSVDLG

SEQ ID NO: 72 - protein, 197 aa, Castor canadensis
MSLLKEDIFLYQFNNQQQVQKPYFRRRTYLCYQLEQPNGSRPQWPAKGCLQNKKGHHAEIRFIKRIHSMGLEQDQDYQITCYITWSPCLACACALAELKNHFPRLTLRIFASRLYFHWIRKFQMGLQHLYKSGVLVAVMSLPEFTDCWEKFVNHRQVFFTPWDKLEEHSRSIQRRLRRILQSWDVDDLTDDFRNLRL

SEQ ID NO: 73 - protein, 189 aa, Ovis aries
MPWISDHVARLDPETFYFQFHNLLYAYGRNCSYICYRVKTWKHRSPVSFDWGVFHNQVYAGTHCHSERRFLSWFCAKKLRPDECYHITWFMSWSPCMKCAELVAGFLGMYQNVTLSIFTARLYYFQKPQYRKGLLRLSDQGACVDIMSYQEFKYCWKKFVYSQRRPFRPWKKLKRNYQLLAAELEDILG

SEQ ID NO: 74 - protein, 541 aa, Blastochloris viridis
MTNPESPPQAPCDFNEDALLNREPLRGSPIKFVSPVDYPDLVFALAGPVGVDIDYIQQSISDCLKSFDYSTEFIRITEIMQDIKCSKTIDCTDMLKEYQSKIEYANELRRAYRAKDLLAALTISAISKLREQIKERDEATNKSNIQPSRRKLAWVVRQLKTPEEVRLLRAVYGKQFVLVSIYSSPQRREDFLISKIKIKSRGTIDNNTSSEGAQRLIERDSKEDNEYGQNLSGTFCLGDIFVDSNNKESAIVSIDRFLNAFFGSNEISPTRDEYGMYLAKTASLRSCDLSRQVGAAIFSKTGEIISLGSNEVPKAGGGTYWTGDNADSRDIRLGHDPNEINKVEIFAEIISRLLEDKLLSNDLLNKDAASIVTILLSKNEGKRYKDLRVMDIIEFGRIIHAEMSAICDAARNGRAIIGATLFCTTFPCHLCAKHIVASGIGRIVYLEPYPKSYAKKLHSDSIQVEDHSDSEKVSFEPFIGISPSRYRELFEGGRRKDPFGEALKWKNDPRKPVIDVVVPPHFEAEKLVIAQLGKLIVSGTG

SEQ ID NO: 75 - protein, 330 aa, Candidatus Woesearchaeota archaeon
MIIGLVGTIGAGKQTIIDYLQEKYGYNALSCSDVLREILKKQGKPVTRDNLREIGNKTREEGGNGAIAKILLEKLRNNWKANYIVDSLRHPDEVSVLRTSPLFHLVAVDADLRIRFERVKARKREEEPTTLPAFVERDQKEMFGTGNEQRIRETMELADELVLNNGTVEELKQRIDDLNLVSDERLRPSWDDYFMRLARLAAQRSNCMSRKVGAIITKDRRVIATGYNGTPRGVKNCNEGGCERCNSAVAKGTAISECLCLHGEENAIIEAGRVRSEGATIYTSFLPCLWCTKMIIQAGLKEVVFSEVYDLHEASIKLFETSGVLIRRLK

SEQ ID NO: 76 - protein, 367 aa, Pseudothermotoga thermarum
MNEFKYMSLALKLAKKGKYTTSPNPMVGAVIVKDGKILATGYHKKAGQPHAEINALSKLNFQAQNCEMYVTLEPCSHYGRTPPCADAIIRSGIRKVVIATLDPNPLVNGKGVEKLKNAGIEVVCGVLEEKAKKLNEKFFKYITTKIPFVALKIAQTLDGKIALKNGESKWITSEKSREYVHKLRMEYDAVLTGIGTILKDDPQLNVRLKKVYKQPLRIILDSKLKIPLSAKVLEDPSKVIILTTALADKEKLEELRSKGVEVIITNEKNGIVDLESALKILGEKKITSVMVEAGPTLLTSFLKESLFDKIYLFIAPKIFGADSKSVFSELGLEDISKSQKFSLESVKKIGEDLLLELYPKQLKKLEE

SEQ ID NO: 77 - protein, 449 aa, Pocillopora damicornis
MEEKSELENELMRSTSPKPSVPNGSKGNECEQRETRITKENLYMVLALWMEEFPVVEQTSSAKRLNKVGVVFVLPTDRVLAADCSRDGVHGVARVMVNHCGKLEGCKVFVSRKPCSLCAKLLVQSKVSRVFYLPIEPESENKGEIARADNLFKNSSVGQSVFVPCVEQKVLDKLEDKLPKEIITPDDISECRDNLLKKCGWSAEWFARAQASLPWPCFEGKMKSQVDNDFKSLIKWIAVVKAPMDKGVAFPKVKLTSDSRVVPDCDADNFPDSKTAYHMMIFAKMLARQTDDPKTGVGAVIVRGKVPDIVSLGWNGFPSKALYGEFPRASDDDRALQKKFPYVIHAEQNALMVRNVKDLTDGILFVTKPPCDECAPMIKLSGVKTIVIGEKIEKSRGGELSYNLIKEYIKEGIMTCYQMEATKTKAKRLASDPETRKRLKSSCSNSNDV

SEQ ID NO: 78 - protein, 414 aa, Chitinimonas sp.
MTKIIDDVNTAAAAVLDQATAAANQTTFAVGGVMVNNQTGEVISAIHNNVIIPLSNNVSFTFDPTAHGERQLVYWYYANKEALKLPEPNQITVITSLDPCAMCTGALLTAGFNVGVVAIDTYAGINCAQNFQFATLPANLRTKAQKNFGYYASGAANFKPLTRSYVGGPSVAFKNGVVTPANLRDCGTVFTQSVDTVRNTSNSTGLAPSQMSNPAELPSNSAILQAYRAIYKKAFTIKIDNPRLPDAQILTELKAVLADAPNARNAVAFIDPFGNLVLCMADAFNTSPVHAAFMNVTQEYAKTRWDLMNKYAQASTTDNPALYLTHPKYGTFVYLYAPDPDDSITIMSLGAYGSTMEGPIPNMFPSNLQFYYPPRNGAQFSELVPVVNELPPFYTQNVNISLMQVPGVTQAPTK

SEQ ID NO: 79 - protein, 308 aa, Unknown
  Description of Unknown: uncultured bacterium sequence
MSSRAKKNRSTNLKKSIGQKSIENKPTDQKKDQVLVAYVPVIHEGYRRFFRHFPAVKELWLISQELSHELRSLQKDIRALKASETKKLLQTWGQFQKIKLLTPSSLAILQKTTTQLVFPDEEISHHLVEKYFAQNRVLFASFFLRWDKKSSLKKHDLQEYSEISNKEFDQMMIAIAQQEADKSDDWWRQVGGLIFKDETILLLAHNQHTPTEAEAYFAGDPRADFHQGEYLKISTAIHAEAYLIAQAAKQGISLEGADLYVTTFPCPVCAKQVAYSGIKRVFFREGYSLLDGETILKANGVKLIRVTV

SEQ ID NO: 80 - protein, 615 aa, Spirochaetes bacterium
MRDLPLLVLGLTGPMGAGCTRFARDISKMEPGKVIKKQGLLDQVAHEISELSKKASEIRLQCISNGKNSELAELKRLNRRLNAKLAERACLHVIAKSSLPEPLFISLNTIVIKIAVDSITAPEFAEWAKNHAKVADLLKWLRTQWESELTLYETWGQDAGRFSQDELEKMDAMFAEFERIGDEILKEDFETYFGKRNNDFSIRMFSENIRLSGNPFRPAENGGGGGKYDEPSMVMIARETDRYIRFYRTRSDQKRSHFFIIDEIKNPREAEYFRARHQNFFLVSIFSSSEIRASRMRRGLGHDAGVSDADFQHLFRELDSRDWGADDFDAHGLHRQNIYRCFNLADIAINNDVEDERFSEVLFNKFIRYYALMLSPGCVQPTPQETYMHLAYSLSLRSTCISRQVGAVITDLEDRILSLGWNEVPEGQIGCGLKVKKDYTDKENPLFEMEIWDNVITAEDLAVWDDEDSICVKDILSRIEIKTKLKSVSLTPEERADVLKALRIKRLEYSRSLHAEENAILQVASRGGVGLKDGTIYVTTFPCELCSKKIYQVGISKIYYTEPYPNSISEKVILKDGIRNIKILQFEGVKSYSYFKLFKPGFDKKDAQMLEGRGI

SEQ ID NO: 81 - protein, 291 aa, Ignavibacteria bacterium
MKHNNQLRKEIEKLLGQNSIIKNDELKKLQKEYKIETDELLISFLPYAAEFAKVPISKYKVGAVVLGKSGNIYFGSNMEFEAGALSATVHAEQSAVNNAWLNGETGINKIAVTAAPCGYCRQFLNELTTAKQLHVLLKDKNLEAAKVFKLTELLPEAFGPRDLEIEGGLMKVENHKLKIENINDELINAALEAANKSYAPYSKNYSGVSIQLSDGTIFSGRYSENAAYNPSLLPFQSALAFMNMNTKKGSNNKIVDAVLVEAVSNISQKDAAGTLLNSISKTKLRYYKIKN

SEQ ID NO: 82 - protein, 398 aa, Scylla olivacea
MEENSSATSQPKCASRTKQGGNDLSTDMSNLSVGETKRTDFLPWDDYFMAVAFLSAMRSKDPSSQVGACIVNADKKIVGIGYNGMPIGCSDDELPWNKESLDPLQTKYMYVCHAEMNAIMNKNSSDLAGCCVYVALFPCNECAKLVIQAGIREVVFFSDKHQQKPETVASKKMLNMAGVAYRQYTPSQSKIELNLSLKEQEKSEPTADITQSSERDQNSKRKDYLSWEEYFMAMAHLSALRSKDPITQVGACIVNSKKKIVGIGYNGMPLGCNDDLMPWGNSSSNKLETKYMYVCHAGVNAIMNKNSCDVSGCTLYVALFPCNECAKVIIQAGIKTIIYASDTNKDQASILASKKMLDMAGIKYRADNLSQRKIVIDFKTIDWNSRFMNDHQNDPTCL

SEQ ID NO: 83 - protein, 259 aa, Helicobacter sp.
MRKNILYFILTLFFLSGLYATSLPEDNVVSGVIYEKIDTVSAEVDHIYPMLALAIVYKDWQEKNMLNKQGHNIGLVIVDENNMPVFWVRNSVHATHNGTQHGEVRLVSNLLNCEGFNKYLDKYTLYTTLEPCIMCAGMLSMVQIPKVVYAQKDLSCGNTQEIISTAKYPRYYKAFTVENGYKKDLEECFEQYKICKNDSITDFLVNDSAKEIFRKASNDLQDYKVKFKENRRVIKVAQEFLQNIQTKDNLDVLQCPKNM

SEQ ID NO: 84 - protein, 256 aa, Bacteroidetes bacterium
MNELTKQSEHLRNEALRIATRSYVPYTGQQEGVIILLENGDLIPGVRVENASFQLTIPALQNALSTMYALQRTDISMIVSSIPFTDSDLAYTGGMAEIAWEMVGASLLLVAGAHIPEAGTFIDPARGENLLDVSREAALNAFIPESDFPVGSAIQTSDDVVIDGCNVEHSDWSKIICAERNVLSTARSYGLGQITTIYVSCPKEPGGTPCGACRQVIVELAPDATVWMDRGNQEPIAMKATKLLPGHFTGNVLKKQ

SEQ ID NO: 85 - protein, 301 aa, Peptococcus niger
MPIVRVNEIGARLPEDWEALETAIWQAYVSREDLPDAGELDLTLVDDATIQELNKTHRQLDKSTDVLSFPMYDDRDDLAADVQAGLPVILGDIMISVPTAERQAQAYGHSFKREMAYLLVHGLLHIAGYDHMSAEEKSAMRRAEEAILADVDVPRDTAPSKTAAVLDEADVQALIDAARAARLQAYAPYSGYAVGAALLAADGRRFCGVNVENASYGATCCAERTALFAAVTAGARDFIALALVTEGDEPAPPCGLCRQALAEFSPDLAIYLAGPTGETYRRTSLAALFPEAFSLSTKESV

SEQ ID NO: 86 - protein, 528 aa, Marinithermus hydrothermalis
MPVMETHALEARFKEALARLCPEGRLLAAVSGGGDSVALLYLLKAAGRDTIVAHLDHALRPDSAADAAFVEKLAQRLGFPLETEHVDVRALAHRKRINLEAAAREVRYAFLARVARRWKARCILTAHTLDDNAETVLLQILRGAGRGLGIRPLQRRVARPLLEFSRAELRAYLEARGARWLEDPTNRSLELDRNYLRHAVLPRITARFPHALEALARFSQAQQADDWALEALSARHLIPDRRWPVPAYRALPLERAPEALRRRAIRGVLEALGVRPEARLVADVEAALGGRAQTLPGGVVVRRQRGTLFFIPPTVRFPKVQPPAGLEARPPRPGDYLVFPYGRKRLVDFLNERGVPRELKRRWPVGAVGAEVRWVYGLWPEPDEDRYMRRALVLARAAARQGEVPIGAVLVRDGAVLAEAANAVEASRDATAHAELLALRTALRRVGEKVLPGATLYVTLEPCPMCYGAILEARVARVVYGVENLKAGAFTVHGLEPRVALEAGRVEGECAKVLKDFFARLRPGRDGA

SEQ ID NO: 87 - protein, 226 aa, Gracilimonas sp.
MINGYTPYSGNQNTCYVKGESGTFYPGVRIENVSYPLTISSVQAAVCSCLANSDNPVEYYTGDHQPELLQVWADEYDMKPGGKLPDSPLKLFDPLVPSIPDIKKELDVLTEKSVTPNSGFPVSALLQTEKGYIRGVNIELSSWALGLCAERVAISRALTAGYTQFKSIHIYAPEADFVSPCGACRQVLLEVMPDADTELYHGDGTLSKHIVSDLLPFGFTSHKLKK

SEQ ID NO: 88 - protein, 321 aa, Ruminococcus sp.
MIHKGTQTIETKRLILRAFTPDDAEAAFENWMSDPKVTEFLRWKTHADISDSRKIVNEWANGSADPEFYQWAIVPKDVNEPIGTISVVDRNDALGIFHIGYCIGSKWWHKGITSEAFSAVIHFLFEEVGANRIESQHDPENIHSGDVMKKCGLTFEGTLRQADFNNRGIVDACVYSILQSEWQNNTSVWQRLYNAALTVQNDRVVSPFIDAGGVAAALMTKKGNIYTGICIDTASTLGMCAERNAVANMLTNGESRIDKIVAVMPDGKVGAPCGACREYMMQLDRDSGDIEILLDLETEKTVRLKDLIPDWWGAERFGDTE

SEQ ID NO: 89 - protein, 229 aa, Ornithinibacillus sp.
MGDIMENWNELSEPWKRCFLQAWKAYCHGSIPIGAVLVDSEGEIFLEGRNRVHELTAPEGQLCDCRIAHAEMNVLVQVKTSDYEKLSGATIYSTMEPCIQCFGAIILSRIKNISFAAIDDKLAGATTLEDRHGFIKSRNLNIAGPFSHLGEIQIILRTDFLLRIFDSEYADPLIAAHEKDYPIGVALGRHYHRNNRLQVAKKETIPFGELFNEFSFDIKRAREGYTLGK

SEQ ID NO: 90 - protein, 205 aa, Rubritalea squalenifaciens
MEASQQNILLKIEGKGPVAEINFTVTLPEWLVEQVQSGSTVFLTQKEKMRFVLELARKNVAQETGGPFAAAVFSLESGELVSAGVNVVVESRCSSAHAEVVALSLAQKAVDSHDLGAAGLPRMVLVSSAEPCAMCMGAIPWSGVKQVICGARDEDVRSVGFDEGAKPLEWVEDFAERGIEVIRDVLREEATEVLWDYRERGGEIY

SEQ ID NO: 91 - protein, 207 aa, Devosia sp.
METAELISRLLDVIEKDIAPVTAKGVARGNKLFGAAILKKSDLAVIVAETNNEIENPLWHGEMQAIKRFFELPADQRPATRDCLFLATHEPCSLCLSGITWSGFDNFYYLFSHQDSRDGFAIPYDIQILKSVYAVPEPETGTVSPARDLYNRSNDFWTSHGLQDMIAGLARSNREALLARIDDLNALYAELSERYQRDKGGKGIPLP

SEQ ID NO: 92 - protein, 231 aa, Flavivirga eckloniae
MSDKKESKIKISKTSESIELDEIHSLLSYSIVQKFWENDDRNGRGYNVGVILVDENKNIVDWDINSVNKTENSTQHGEMRLISRYLDKDELYSLKGYTMYPTLEPCAMCAGMMTMTNVYRTVNGQMDYFYSKALERLSIDTRECGGYPPYPRTVISEISPSSISTRLDAEYKQYTNAGNKPIITKFLSTYKAKTIYDDAFNQFINFKCKFPENKTKYENAIKFYNSLPESI

SEQ ID NO: 93 - protein, 330 aa, Cavenderia fasciculata
MRFSLSLLFVILSVLLAGVLACKDPYNPETVDYGQCASATKANYEVRSDSKVLTPADLPADELAVHESRMRHIIDIARVNNKKFVSSIYFPNGTLACIGINTGKPNMIAHGEIVAIQNCTEIHGISMYTNYSIYTTGEPCSMCASAILWSRFKTVVWSTYNSDLYCKICMSNIPIDSSYIFSRAYGLGIEAPVAIGGVVKAEGDAWFGTYCNRPTSIYYIAPKCACQDPAKVSPLKFTQTRTTVWVEGGDKVVTQWNAIISNPSNSTIVDPPIVISPSVVFKGAPWGISAASEPNTYKLSYNKVLFPGQTFSFGYSVYGLEEVAFTALEA

SEQ ID NO: 94 - protein, 193 aa, Photorhabdus temperata
MNKTRRKLLATLGIMSISMSFIAQAGEKKTQVINNILSKQEITEHEKYMREAIKEAIKNPKHPFGAVIVNRNNGEILSRGVNTGRNNPILHGEIQAINHYITQYGNQGWENVALYTTGEPCSMCMSALVWIGIREVIWATSISVIRNSGIRQIDISAHEIAERASSFYNPITLVGGILANETDKLFLERKRGN

SEQ ID NO: 95 - protein, 319 aa, Pseudozyma antarctica
MASRRHLLATQVTGNHRKLSLWHLRGWLSPYTKLVDAVYFLTTNSFYHSLQTPPVQSITMLLSSIITSLALAAQASAYREGLHPEFQSGLSINSVPATDRDHWMRLANSAIYYPPVSHPCPQAPFGTAIVNTTSNELICAIANRVGSTGDPTQHGEITAIQHCTNVMRKKGLSPQEIIAAWKQLSLYTNAEPCTMCLSAIRWAGFKEVIYGTSVGTISENGRNQIYIPSNLVLEKSYSFGHATLMLGNILTHETDPFFQHQFNESAPCPVGCERTQVGEARVKTCEPVPNWQKLVRLEYSEDSRVGSEPVAHTPLHLEL

SEQ ID NO: 96 - protein, 203 aa, Morganella sp.
MDYSDAILGAITSIRRNSKQPGVNVTDNVTDSSTQYNNDEYWMRRALALAREAGEAGEIPVGAVLVKDNQQVAGGFNQPIRSHDPAAHAEILTLREAGAVLGNYRLIDTTLYVTLEPCMMCAGALVHSRIKRLVFGAAEPKTGAAGSFIDLLTLPRLNHYMEVTGGVLGEECSVLLSDFFRRRRAEKKALKRQNSESGSDSAS

SEQ ID NO: 97 - protein, 270 aa, Micromonospora cremea
MLEKIERRLVAAAEAVVRSPSTGDAHTVAAAAMDANGDIYSGVNVFHFTGGPCAELVVIGSAAAANAPPLITIVAVGDGDRGVIAPCGRCRQVMLDLHPDVFVIVPTGDGQLAAKPVRELLPFGYVARTGSTAPRVVYFHPRHYDTISSGLKTATVRFQDSVQTGPAVFVFDDGESIRRLDAVVEKVESRRLDHLTEEDAHHEALPDSDALRDAIKTQYPMLGDGDVVDVATFRLTAISAPDPDPRSSYPPAVSRCNPAGPRADLLVGQS

SEQ ID NO: 98 - protein, 257 aa, Unknown
  Description of Unknown: Marine sediment metagenome sequence
MTKDGRVIASAHDTEVTDQDSTAHAEINAIRKASKIYRKDLTGCLIISTHEPCPMCTGSIIWSNISKVVYGVSIRDSIKAGRDMINLSCKEIIKKPNAEINIYDGILKKECLKLYNNDTRKLVKKFRKYEWINIEENLLNKRMQWFENNKTMIRKLKGNDLEKAYHLILMKIGIKRSEAPIVKKSESKIIFHSKNYCPSLEACIILDLDTREVCKEIYERPTEELIRRLNSKLRFTRNYDCIRPYSDYCEEIIILEK

SEQ ID NO: 99 - protein, 154 aa, Cytophagales bacterium
MPSHEDFIHQCLELGKEALLQGNPPVGSVIVWQDQVIGRGIENGRSSGDITQHAELLALQEAVATGQRDKLKEAIIYSTHEPCVMCAYPIRQYKIPTVVYSVAVPELGGHTSSWHLLTTEDVPKWGKAPKIITGISAEEVEALNAAFQDSLKKG

SEQ ID NO: 100 - protein, 180 aa, Flavobacterium columnare
MFIFKLISPPVSIEVYQDKIIQKLYICFMENIFTDEYFMKKALQEAETAFQQGEIPVGAVIVIDNRIIARSHNLTEMLNDVTAHAEMQAITASANFLGGKYLKDCTLYVTLEPCQMCAGALYWSQISKIVYGATDEQRGYRAMGAQLHPKTKVISGIMQNECTHLMKDFFKQRRSKSTKD

SEQ ID NO: 101 - protein, 178 aa, Cecembia lonarensis
MVKNPVNNNELYFGKHSEIPMNEEQKAYMKMAVDLSRSGMESGKGGPFGCVIVKDGKVIGIGSNSVLETNDPTAHAEIVAIRDACRNLGHFQLDGCEVYTSCEPCPMCLGAIYWARPSKVFFANDKRDAAEAGFDDDFIYQELELPYEKRKIPFEQGMQDTAKEVFQEWILKEDKTLY

SEQ ID NO: 102 - protein, 196 aa, Taphrina deformans
MSSEIEPPSTDVHKHAVAEAADESGAADAFMQIALQQAETALLNKEVPVGCVFVHQPTGTVLATGANQTNASLNGTLHAEFVAIESILRDHPPSIFRESDLYVTVEPCVMCASALRQLQVRKVYFGCGNDRFGGCGSVFSIHSDASKTGDAAYMVESGIFRKEAIMLLRRFYLLQNESAPKPALKSTRVLKEHFDE

SEQ ID NO: 103 - protein, 212 aa, Desulfovibrio mexicanus
MSPASKKHFPSLFSFLLLTIGLICGTAHAQPQGHTADDTAATLANASLKEHEPFIRRCYQLAIDAGKKGNHPFGALLVHKGKIVLEAENTVLTDNDFTNHAEMNLIAEAARTLSRQIIPEATVYTSCAPCAMCTATLAMAGFTRIVYGVSHDALNKRFGLKGKSVSCPALFKTMGMELEFVGPVLEKEGLRVFDFWPEKDPHAQMLKKQARK

SEQ ID NO: 104 - protein, 320 aa, Candidatus Saccharibacteria bacterium
MTEFNYDWAKLAFSSKRPLTNLKATFIIAPREISEKRFTQLLKEYLPKGDILLGISKEDYVEGLEGQPQFAMLQQKTLQKLIDKVNDASAHKVYTLRYFQRELPAIIEKLTPPRVVGIHGSWHHSFHTLPIYYLLSEKRIPYQLVAAFSDEDEARAYEVATDKKIVRPTLEGSFDDTTVLQLTDEVAKSSYDYGFQTGAILAEKVNGVYQPVAAGFNKVVPYQTYALLNGASRETNFSPANDMNHYDTIHAEMQILVEAAKQGISLKDKTLFVNLMPCPSCARTLSQTELSEIVYRIDHSGGYAVDLLTKVGKDIRRIVY

SEQ ID NO: 105 - protein, 180 aa, Deltaproteobacteria bacterium
MKERTVSYSDRHFMAEALEMAESALTQGEFPVGCVIADGTAVVARGHRTGTTAGAVNEIDHAEINALRHLGLAGEHLDRTDLTIYSTMEPCLMCFAAIVLSGINRIVYAYEDVMGGGTGCDLTGLPPLYRDAPLTLVAGVRRRASLNLFRRFFTDPENGYWAGSLLSRYTLNQTKDSHRL

SEQ ID NO: 106 - protein, 156 aa, Parcubacteria group bacterium
MQSVQYNKLTHLQRRALDEAEQVLENSYNPYSHFYVGACLISEDEQLIAGTNFENAAYGSAICAERAAVLRANAMSIRRFRGIAIIARGEDFNTTEVTGPCGSCRQVLYEISQVSGCDLQVILATSKKDKIVITTIRELLPLAFGPLDLGVDIGKY

SEQ ID NO: 107 - protein, 217 aa, Rhodoplanes roseus
MVTSRDGEDEAMMARCVALSRIAVGKGEYPFGAVVAREGRIVAEAINRTIRDGDVSRHAEVIALARAQKAIGRRELRECSLYSNVEPCAMCSYCIREAWVGRVVYALGSPVMGGVSKWNILRDDGLSGRMPQVFDAAPEVVSGVLVEQAQAAWRDWSPLAWEMITLRGLMTDPSARPECRTRAARPRSLWHHLVALIERPPRPYVDPTSAAEGHADL

SEQ ID NO: 108 - protein, 162 aa, Indibacter alkaliphilus
MKMKKKIEITVSLEVIQKSEWSKEDRSLIERAIHAVEHAHAPYSNFMVGTALLLDNGQIFSANNQENVSFPVGICAERAVLSYAMGNFPNNRPVKLAVVAKRRSDSTWATVTPCGLCRQTINEYEVKFGHPIEILMLNPGEEILKASGIDQLLPFRFNDLNS

SEQ ID NO: 109 - protein, 153 aa, Adhaeribacter sp.
MEEHEKWMHWCLNLAQQALQQGDFPVGAVVVQKGKLIGQGVEAGQLKKDITCHAEMEAIRDARQTINTADLQNCILYSTHEPCIMCSYVIRHHKISRVVVGTTVPEVGGSSSAYPLLSAPDISIWVAPPHLVTGVLAEACQALSQAYKQKFKK

SEQ ID NO: 110 - protein, 159 aa, Mesorhizobium sp.
MTNPSRQERWDRRFLELAKVFGTWSKDRSAGTGCVIVGPDRLLRASGYNGFARGIDDEVPERHERPAKYSWTEHAERNAIYNAAKLGISLDGCTAYVNWFPCIDCARAIVQAGIVRLVGLHPDHADQRWGSEFKFATEMLRESGIEIILYDIPELAARK

SEQ ID NO: 111 - protein, 490 aa, Onchocerca flexuosa
MEEMARKIRTKAKKANSYCNTMTFLISKASIVLLKAECKRIELTVVIFRFLIKMNASEPNNELCDMTVIKSMLKITHVIFDLDGLLIDTEVVFSKVNQCLLSKYNKKFTPHLRGLVTGMPKKAAVTYILEHEKLSAKVDVDEYCKKYDEMAEEMLPKCSLMPGVMKLVRHLKTHSIPMAICTGATKKEFEIKTRYHKELLDLISLRVLSGDDPAVKRGKPAPDPFLVTMDRFKQKPEKAENVLVFEDAANGVCAAIAAGMNVIMVPDLTYMKIPEGLQNKINSFSDNLIISNDLNVALMSLKKELSEEEVHFLNRAFEIAVDAVLNNEVPVGCVFVFEGQEVAFGRNDVNRTKNPTYHAEMVALKMMKQWCMDNGRDLEEIMRRTTLYVTLEPCIMCASALYHLRLKKILYGAANERFGGLVSVGTREKYGAKHFIEIMPNLSVDRAVKLLKEFYEKQNPFCPEEKRKVKKPKKSGNNNDNSDDAVALNV

SEQ ID NO: 112 - protein, 159 aa, Candidatus Peregrinibacteria bacterium
MAYQPSEKFMQMAIDKTREGVLSGQTPFGACIVKDGKVVACEHNTVWQDTDITSHGEVHTIRAACKAIGSIDLSGCILYSTCEPCPMCFSAIHWARIDTVVYGAFIADAQDAGFNELTISNEKMKEFGGSPVNFISGFMRDENVALFKLWKEQGANNVY

SEQ ID NO: 113 - protein, 168 aa, Prolixibacteraceae bacterium
MKTTEIRIIVHEYQNIDELTENDQYLLHEARRITEFAYAPYSGFHVGAAILLGNGMIVKGNNQENSAYPSGLCAERVALFYANANYPDSEVKTIAISAAKNGILVNDPIKPCGGCRQTLSEAEVRFGSPIRIILDGQDSILVLHGVESLLPLSFSKKDLASPLAATGR

SEQ ID NO: 114 - protein, 214 aa, Polaromonas sp.
MKFKLDPSRPPDEDDYYLGVALAVRRKANCTGNRVAAVIVKNKRVIATGYNGVPEDMPNCLDGGCLRCSNPGGQFKSGTRYDLCICVHAEQNALLTAARFGISVEGAHLYTTMQPCFGCAKEILQAKIEKVFYLHPWVPTDVDPVMDAAMKAEYAKIIGKLKVKKLDFDDPVATWAVTTMRQAALASDKNPDKKTPPKTAKKKVAKKKSRTSPR

SEQ ID NO: 115 - protein, 155 aa, Methylomicrobium album
MNHEHFMRRAIELARQAPQYPFGAVIVRRDDGQCVGQGFNRSDLNPTYHGEMVAINDCAVRHCAEDWRGFDLYTTAEPCAMCQGAIEWAGIGRVFYGTSIPYLQKLGWWQIDLRAAEVSARAVFRDTLIVGGILETECNALFAAARRGCFGTGSE

SEQ ID NO: 116 - protein, 156 aa, Anaerolineae bacterium
MDEHDIRFLRASFDVARNARKNGNHPFGALLVDEHGRIVMEAENTVITAKDCTGHAETNLMREASSKYDSDFLANCTIYTSTEPCPMCAGAIFWSNVRRVVYGLSEESLYEIAGRGSEEVLFLSCREIFERGKKLIEVIGPLLEDEAREVHMGFWR

SEQ ID NO: 117 - protein, 193 aa, Unknown
  Description of Unknown: Shigella phage sequence
MKPTTVLQIAYLVSQESKCCSWKVGAVIEKNGRIISTGYNGSPAGGVNCCEHAEEQGWLLNKPKPVLIPGHKSECVRFSQVDRFVLAKAHREAHSAWSKNNEIHAELNAILFAARMGSSIEGATMYVTLSPCPDCAKAISQSGIKKLVYCETYDKNIPGWDDILKNAGIEVFNVPKRSLDKLNWENINEFCGE

SEQ ID NO: 118 - protein, 330 aa, Thermodesulfatator indicus
MIRAPWHEYFMLLAKIVALRSGCNSRPSGAVIVKNKRILATGYNGPMPGAWHCTDRGPGYCFRREKGIPDIDKYNFCRATHAEANAIAQAARFGISVEGASLYCTLAPCYVCLKLIASAGIKKVYYEHDYGSRDFERDQFWKEAIKEAGLEKFEQITVSQEVMEQLQEILPYPTSKRRLAPTEFLDEFEDGKKYGVPSIEVLFNKLNYLTRQALKDITFVIEKTTVTEEPEGISFYLSGKMVELSELINTVKKQINADQNFYFLAKHNAIEAKIEILREAENIRLKAFLNECPLESFKRIAESLDYILYQVSNSLSLPTRLELSVNLLRI

SEQ ID NO: 119 - protein, 158 aa, Paulinella longichromatophora
MKKQLSRKIQEEWMSRLLRNAYDAGTYGEVPIAAVILNESGQCIGWGRNCREKDQNPLGHAEIIALRQASYLKKSWRFNECTMLVTLEPCPMCAGALLQARINHIIYGASDYKRGGFGGVLDLSKNSSAHHKIEITRGVKSIQSCQLLETWFRRRRRV

SEQ ID NO: 120 - protein, 176 aa, Pseudomonas delhiensis
MEGRAGIIPFDEGGAAMGPAEEDSPMQHLAYMREALALARANVEAGGRPFGAVLVRDGEVIARAANGTHLDHDPTAHAELLALRAAGRALGSPRLDGCVVYASGHPCPMCLAAMHLSGVSAAYYAYSNADGEPYGLSTAAVYAQMAQPVEWQSLPLQALRPEDEEGLYGFWRERRP

SEQ ID NO: 121 - protein, 199 aa, Pseudomonas sp.
MHPEHLALLQQAPASTHADDTWARLCCEQALLAVEEGCYAVGALLVDGAGELLCSGRNQVFAPAYASAAHAEMRVLDQLEAEHAQVDRRSLTLYVSLEPCLMCYGRILLAGITRVRYLARDRDGGFALRHGRLPPAWANLASGLSVVQAKADPYWLDLAEHAIGRLQDRQTLRQRVIRAWRGQRTLTDEFSSTKRTHSG

SEQ ID NO: 122 - protein, 402 aa, Cynara cardunculus
YIRELHASSLRRDEHEIQNPKILVIVDRLSSPSLHVSLSLSLSLVIFPPFIPLNQTPTHMENAKVVEAKDGTIAVASAFSGHQEVVQDRDHKFLTRAVEEAYKGVECGDGGPFGAVVVHKDEVVASCHNMVLKHTDPTAHAEVTAIREACKKLNKIELSDCEIYASCEPCPMCFGAIHLSRIKRLIYGAKAEAAIAIGFDDFIADALRGTGFYQKAHLEIKQADGNGAMIAEQVFEKTKAKFAIDHKFLTRAVEEAYKGVECGDGRPFGALVVHKDEVVVSCHNMVLNYTDPTAHAEITAIREACKKLNRIELSDCEMYSSCEPCPMCFGAIQISRIKRLVYGAKAEASIASGIPIGDFISDALKGTGFHEKANFEIKQADGNGAMIAEQVFERTKAMFPKR

SEQ ID NO: 123 - protein, 195 aa, Lepisosteus oculatus
NSSTRESRVMAQMEINGGASPPKKPGKGQSAADQDMITGLINKALQAKEFAYCPYSNFRVGAALMTNDGRVFTGCNVENACYNLGVCAERTAILKAVSEGYESFRAIAVSSDLQDQFISPCGACRQVMREFGTGWDVFLTKVDGSYVRMTVDELLPMSFGPDDLKKKKVFSLQNGHEVSTQFYTHSPCEAGENNN

SEQ ID NO: 124 - protein, 134 aa, Alteromonas sp.
MSNSETEHIQALVDAAQAAQKQSYSPYSSFQVGAAIFADDGNTYSGCNIENVAYPLGQCAEATAIGMMIMQGAKRIEDIMIASPNDQVCPPCGGCRQKISEFGTAETKIHMVTRSGEVSTVTLGELLPLAFDSL

SEQ ID NO: 125 - protein, 162 aa, Amanita thiersii
MTNSTLSNEDRTRLIQGAFQARKKTYSPYSNFPVGAALLTTDGRIIEGANIENASYGGTICAERTAIVKAVSDGYRHFAGIAVTTKMPTRVSPCGICRQVLREFCSLDMPVLLVPGDYPQRNPVDDDGADKPGVITEGGVRETTLGALLPDSFGPENLPPRA

SEQ ID NO: 126 - protein, 163 aa, Colwelliaceae bacterium
MNIENLITENDETLIRRCIELAGESVKNGDKPFGALLAKDGNIIFESSNNAKTKVPYHAEILTLMDAQDKLNTTDLSDYALYSNCEPCPMCSFMIREYKLDKVVFSVHSPYMGGQSRWNILEDDVLTRFKPYFSKPPNVVGGVLESEGKRIFDKVGLWMFGKE

SEQ ID NO: 127 - protein, 204 aa, Brucella ovis
MHAKGYSQQERRIIPFANRFRFRELCSNKSLHGLRAKFPEQYTKWDPMRKAASITKANSATPMDIALEEAHAAGERGEVPIGAVIVRDGEIIARAGNRTREFNDVTAHAEILTIRQAGEMLGSERLIDCDLYVTLEPCAMCAAAISFARIRRLYYGASDPKGGGIEHGGRFYTQPTCHHAPEIYPGFCEADARKILKDFFREKR

SEQ ID NO: 128 - protein, 165 aa, Enterococcus sp.
MFIVKNNIEVIQQQAELDAKFMKQALKLAKDASNNGNEPFGAVLVKNDKVILTGENQIHTESDPTYHAELGIIRDFCTSQKITDLSEYTLYTSCEPCCMCAGAMVWSNLDRMVYGLGHDELAEIAGFNIMIGSEEIFSKSPNRPEVAKGVLKEAAVPVYVDYFQR

SEQ ID NO: 129 - protein, 181 aa, Candidatus Carbobacillus altaicus
MSGRISWHEYFMAQAKLIALRATCTRLMVGAVIVRDRRVIAGGYNGSIAGDEHCIDVGCKVRDGHCIRTIHAEQNALMQCAKFGVSTDGAELYVTHFPCLNCTKLLIQAGIRHIYYEVPYRVDPYAIELLEKAGVGTTQITVDLNAYVQVMSKVSTDPALTYVPESKAQKDEYGQSVGKIV

SEQ ID NO: 130 - protein, 173 aa, Cephaloticoccus capnophilus
MSEANASSESLPSRNSPVELIAEAAGKFGRRPTWDEYFMATAVLISTRSSCERLNVGCVIVTAGESHKNRIVAAGYNGHLPGSPHTSRMRDGHEQATVHAEQNAISDAARRGSSVEGCTAYVTHYPCINCAKILASAGIAKICYRLDYHNDPLVKPMLAEAGIEIVQLGEAAS

SEQ ID NO: 131 - protein, 170 aa, Rickettsia endosymbiont of Culicoides newsteadi
MVMKKKLITVKRSTEFNNFFMEEALKQAQFALDKNEIPVGAIIVNRITNKVIAKAHNIVEQTKNPVLHAEIVAINQSCQILSSKNLSDCDMYVTLEPCVMCSGAISFARIGRLFYAANDPKQGAIENGGRFFNSKSCFYRPEIYSGFSAKISENLIKEFFYNVRYQKCNP

SEQ ID NO: 132 - protein, 146 aa, Vibrio sp.
MTDNSLHESYMRQAFELSKSALPGCRPNPPVGCVFVKDGEVVSSGFSQPPGNHHAEAGAIAAYTGSYDGLVAYVTLEPCSFQGRTPSCAKALVRVRPEKVYVAILDPDTRNSGAGIKILEDAGIDVEVGLLGEEVASFLNPYLIRN

SEQ ID NO: 133 - protein, 159 aa, Candidatus Dependentiae bacterium
MTKKETTKLHALDDFCMKKALLLAKRAFRADEVPVGALVVDSSNKVIGRGYNQVEKRKSQRAHAEQLAIEQACKKIGDWRLEGCTLYVTLEPCTMCMGLIKLSRIERVVFGAASPLFGYQLDKNRKSQLYKKGVIKIRKGVGKATAAALLKDFFKNKRM

SEQ ID NO: 134 - protein, 167 aa, Bacillus sp.
MKNNGRLDHEYFMTEALQEAKEAGQRGDLPIGAVIVHNGRIIARGSNMRKTAGIKISHAENNAMHNCAPYLMKHASECVIYTTLEPCIMCLTTLVMANIDSIVFAADDKYMNMKPFIDANSYIRDRIHQYKGGVCRGESEALLRKYSPYAAELALNGTHPHHRKGGA

SEQ ID NO: 135 - protein, 165 aa, Caenorhabditis remanei
LYKLYIFRMTTTKANLTQFEQELVDKAVGAMEKAYCKYSGFKVGAALVCEDGEIIIGANHENASYGATICAERSAMVTALTKGHRKFKLLAVATELEAPCSPCGICRQYLIEFGDYKVILGSSTSDQIIETTTYGLLPYAFTPKSLDDHEKEAEERNHQEGEKKH

SEQ ID NO: 136 - protein, 162 aa, Gammaproteobacteria bacterium
MKELLIHSWLMLNSNSKLIMERVIELSEINLKNGKIPIAAVIVDKKNYEIISESQNEDSPIGHAELLAITKALKKLNTNRLDSTNLFVTIEPCPMCAYAISKCHINRLYFGSEDEKGGGVINGPRIFESHNLKKIDYVSHCYHEKTTQLMQSFFQLKRNQQL

SEQ ID NO: 137 - protein, 133 aa, Legionella wadsworthii
MDTIIKKMISNAHNTLAHSYSPYSKFSVASCICTDKDNFYTGVNVENSAYGLAICAETSAISAMVTAGEKRIKSMVVMAGTNILCSPCGACRQRIYEFSTPDTLIHLCDKNSILRTFKINELLPEAFKFDFNP

SEQ ID NO: 138 - protein, 370 aa, Pseudocercospora eumusae
MADSLKSKPGHARHDTALIHGLSQSDVQKLSESCVDAKSKAYCPYSHFRVGCAVLLANGDVVQGANVENAAYPVGTCAERVALGTAVGAKKGDFRALAVSTDISPPASPCGMCRQFIREFCELNTPILMYDKDGKSVVMTLEQLLPMSFGPDKLLPPGQLENGLMQTQTQSSFVTRAFSTTSSRRQDDTPQVPQSHYDFFPQTFPQGPPPKTSFSPDLKQLRKEFLQLQAKAHPDLAPQDQKRRAEALSMRINEAYKTLQSPLRRAQYLLSQQGIDVEDETAKLDDSSLLMEVMEAREAVEEVEDEEQLNEIRAENNGRIEESVRVLEDAFRDNEFEKAAQEAIRLRYWVNIEESIQGWEKGNGGGILHH

SEQ ID NO: 139 - protein, 165 aa, Vibrio sp.
MCNLKENKDMDKYFHFACDATIEGMREGTGGPFGATLTRNGEVVCSVANTVLKDMDISGHAEMVAVREACKKLDTLDLSDCVMYATCEPCPMCVSVMLWAGIKTCYYASTHLDAAKHGFSDQQLRDYLDGSDTSTLNMVHIEDNRDDCAKIWTEFRHLNETKNDG

SEQ ID NO: 140 - protein, 509 aa, Nothobranchius furzeri
MEHSDRWSRAEPGLSTSSRETRDGSTQTDCKLQGHGPRLSKVNLFTLLSLWMELFPQEQDEENGQSQIRRSGLVVVREGKVVGLHCSGADLHAGQAAILQHGASLANCQLFFSRRPCATCLKMIINAGVRQITFWPGDPEISMLTSNQTHSQRTSQSITEASLDATAVEKLKSNSRPQICVLMQPLAPGVLQFVDETSRRSDFMERMMDDDPELDSEKLFNSDRLRHLKDFCRHFLIQTDQRHKDILSQMGLKNFCVEPYFSNLRSNMTELVEVLAAVAAGMPQQHYGFYREESLSLDPHPVDVSQAVARHCIVQARLLSYRTEDPKVGVGAVIWAKGQSACCCGTGRLYLIGCGYNAYPAGSKYAEYPQMDNKQEDRERRKYRYIVHAEQNALTFRTRDIKPDECSMLFVTKCPCDECIPLIRGAGVKHIYTSDQDRDKDKGDISYLRFGSLKGVCKFIWQRSPPVSSASSLHLTNGCVGKHVRQAEQQIYKNKKLCTKGSSGSSDIC

SEQ ID NO: 141 - protein, 148 aa, Clostridium citroniae
MEKEITNMDKQKLIQMAVDGLGRSYAPYSHFHVSAALLCADGTVYTGNNIENAAYTPSVCAERCAIFKAVGDGRREFEAIAVCGGPDGVIEDYCPPCGVCRQVMREFCDPSSFRVLVAKTAEDYREYTLEQLLPDGFGPDHLTGSGER

SEQ ID NO: 142 - protein, 221 aa, Gemmatimonadetes bacterium
MARPVHLHTGERRTEEGATESRAVAAVATAITRAPRAPPRPATGRERDGPPPRRVFGGGLRVGDPSGYDRGESKPIGGPLTEKRSDWHSYFMRIAGEVATRATCDRKHVGAVIVRNRTILSTGYNGSIRGMPHCDDVGHDMVDGHCIATIHAEANAILQAARNGVMIQDGSIYITASPCWNCFKLVANAGLKRVYYGEFYRDKRSFEVARRLGIDLMHIEV

SEQ ID NO: 143 - protein, 155 aa, Bacillus sp.
MEGVQLIYQFQWGNLIMTVNKEDLYLIDVARNTIKTLYVDGKHHVGAAVRTKTGKIYSAVHLEANIGRVSVCAEAIALGKAISEGESEFDTIVAVRHPDPTQENQKIEVVSPCGICRELISDYGKGTNVILKNKEGYIKTVISDLLPNKYIREDN

SEQ ID NO: 144 - protein, 156 aa, Halobacillus mangrovi
MNRFMERAVSLAAENVRVGGQPFGAVLVKDDELVAEGVNEMHLNYDVSGHAELLAIRRAQGELQTHDLSGYTMYASGEPCPMCLSAMYFAGIKDVFYCATVEEAAQVGLEKSKNVYDDLQKSKGERSLVMKQMPLEDDQEDPMKLWDERTNHNGTS

SEQ ID NO: 145 - protein, 340 aa, Mycolicibacterium fortuitum
MVHAQFDPTARQALAATAVEAKTRKDLTWQQIADAAELSPAFVTAAVLGQHALPARSAEAVAALLGLDDDAALLLQTIPIRGSIPGGIPTDPTIYRFYEMLQVYGTTLKALVHEQFGDGIISAINFKLDVRKVADPEGGERAVITLDGKYLPPNPFDRVRYRGGLMDFAQRTIDIARQNVAEGGRPFATVIVKNGEILAESPNLVAQTHDPTAHAEILAIRKACTRIGTEHLIGATIYVLAQPCPMCLGSLYYCSPDEVVFLTTRDAYEPHYVDDRKYFELNMFYDEFAKPWDQRRLPMRYEPRDAAVDVYKLWQERNGGERRVPGAPTSTRPGKNPRGE

SEQ ID NO: 146 - protein, 157 aa, Sinorhizobium fredii
MKQRCMSPKSAQRFWDNDMHNNKDRPMSENELFVAAREAMAKAHAPYSKFPVGAAIRAEDGQIYTGANIENLSFPEGWCAETTAISHMVMAGQRKIMEVAVIAEKLALCPPCGGCRQRLAEFSGASTRIYLCDETGIKKSLALSDLLPHSFETEILG

SEQ ID NO: 147 - protein, 595 aa, Alicyclobacillus acidocaldarius
MDAKELETRGWLCMRAVDVIDKKRRGEALAEEELRFLIEGYVAGRIPDYQMSAFLMAVVWRGMTREETLVLTRLLADSGERLDLSGIPGVKVDKHSTGGVGDKATLVVLPLVASIGVPVIKMSGRGLGHTGGTIDKLESIPGFRTDLSVAELVAQVRQVGIALGGQTADLAPADKKLYALRDVTGTVESLPLIASSVMSKKLAGGADAIVLDVKVGDGAFMKSRSDARRLARLMVEIGEAAGRRTVAVLSNMDQPLGCAIGNALEVAEAIRVLSGEGPFDLAEIALALAEEMTVLAGVAATREEARRMLRQSVAEGRALETLRRWIAAQGGDPAVVDDPSRLPQAPVQMPYLPKKAGFVAKLSALAFGLAAMRLGAGRETKEEAIDPSVGIVLHAKVGDRVQTHRPMFTVHARTGEDALRCIQELEAAIQISDDPVEAPPLILARIDRSEALPYADLMDAAREARDRAYVPYSGFAVGAALELADGRMVTGANVENASYGLTNCAERSAVFRAVAEGGPGTKPEIRAVAVIADSPEPVSPCGACRQVLAEFCSPDTPVYLGNLQGDVRETTVGALLPGAFTDAQMANVRRQDKEA

SEQ ID NO: 148 - protein, 153 aa, Spirochaetes bacterium
MKTTNINALDKWDLRFLQMAEHVAEWSKDPSTKVGAVIVRPDRTIASVGFNGFARGVRDTVERLWNRELKYPLTVHAELNAILSAHEPVRGHSLYVSPLSPCSNCAGVIIQSGIARVVAKCGQVNNPAQWSESFNLALTAFAEAGVSVILVEH

SEQ ID NO: 149 - protein, 177 aa, Citricoccus muralis
MEQNDHGSSGAFSDPFEDDIPLTASLPRITGTGSGIDWQRLESTARAAMTRAYVPYSRFPVGAAALVEDGRVVAGCNIENASLGLTLCAECSLVSNLQMSGGGRIVAFYCVDGNGEVLMPCGRCRQLLYEFHAPGMRLMGPDGELTMDEVLPLAFGPADMTHLSDSAASTDDPGRTR

SEQ ID NO: 150 - protein, 172 aa, Elusimicrobia bacterium
MAKPISKKYRKLIETAKAARKKAYSPYSRYQVGAAVLTESGRIYSGANMENASYGLCMCAERVAIANAVTRGEKVLQAVCVVGKKARPCGACRQVMLEFSTKETELLMVDIDPNARRDTVIRTRVYSMLPNPFDPFESGMLPQHPQNLLRRRKSPQPRRKRRSRPVHREVSR

SEQ ID NO: 151 - protein, 391 aa, Anopheles albimanus
MPRPSQFRVSSSQSLSNSQIQASQSSDSVVDITSYVNAVVKALLNLSCTKTIIKRADLVNIALKGNGRLIGRVLQDANIELKEIYGYELIEVEKSKTMILCSTLAAGSMDELNDANRRRYTFLYLILGYIFMKNGSVPETIVWEFLETLGIEEQQEHNYFGDVRKLYDSLFKQAYLTRTKQALEGLNDDVMLISWGVRSKHEVSKKDILAGFCKVMNRDPVDFKAQYIEANEKDDKMNNNINGTVDGRNTVEYSSLDASVKELIEAAIKVRNNAYCPYSNFAVGAALRTVGGDIVTGCNVENGTFGPSVCAERTAVCKAVSEGHREFTAVAVVAFQETEFTAPCGTCRQTLSEFSRKDIPIYLVKPSPVRVMVTSLFQLLPHAFSPSFLNK

SEQ ID NO: 152 - protein, 151 aa, Bacillus aryabhattai
MEPKKLIEEAIVASKQAYVQYSNFHVGAALLTKDGKLYHGCNIENASYGLTNCAERTAIFKAVSEGEKEFQAIAVVGDTEGPISPCGACRQVLAEFFSPDTVVILANLKGDHVVTNINELLPGFFSSKDLQKKVKNCFEKNALGSSCLRPI

SEQ ID NO: 153 - protein, 229 aa, Aspergillus versicolor
MPLSAEEAALVETATATINSIPLSEDYSVASAAKASDGRVFTGVNVYHFTGGPCAELVVLGVAAAAGAAQLTHIVAVANEQRGILSPCGRCRQVLLDLQPNIQVIVGKEGSEQSVPVAQLLPFSYRQPDQHTPVIFKALTSSGPVVVDFFATWCGPCKAVAPVVGKLSETYTDVRFIQVDVDKARSISQEHDIRAMPTFVLYKDGKLLDKRVVGGNMKELEEQIKAIIA

SEQ ID NO: 154 - protein, 236 aa, Unknown; identical to SEQ ID NO: 5
  Description of Unknown: Cytidine deaminase sequence

SEQ ID NO: 155 - protein, 194 aa, Unknown; identical to SEQ ID NO: 44
  Description of Unknown: Cytidine deaminase sequence

SEQ ID NO: 156 - protein, 192 aa, Unknown; identical to SEQ ID NO: 61
  Description of Unknown: Cytidine deaminase sequence

SEQ ID NO: 157 - protein, 280 aa, Unknown; identical to SEQ ID NO: 69
  Description of Unknown: Cytidine deaminase sequence

SEQ ID NO: 158 - protein, 236 aa, Artificial Sequence; identical to SEQ ID NO: 5
  Description of Artificial Sequence: Synthetic polypeptide

SEQ ID NO: 159 - protein, 194 aa, Artificial Sequence; identical to SEQ ID NO: 44
  Description of Artificial Sequence: Synthetic polypeptide

SEQ ID NO: 160 - protein, 192 aa, Artificial Sequence; identical to SEQ ID NO: 61
  Description of Artificial Sequence: Synthetic polypeptide

SEQ ID NO: 161 - protein, 280 aa, Artificial Sequence; identical to SEQ ID NO: 69
  Description of Artificial Sequence: Synthetic polypeptide

SEQ ID NO: 162 - protein, 304 aa, Homo sapiens
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 163 - protein, 313 aa, Homo sapiens
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 164 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 165 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 166 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 167 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 168 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 169 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 170 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 171 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 172 - protein, 1410 aa, Artificial Sequence
  Description of Artificial Sequence: Synthetic polypeptide
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 173 - DNA, 8811 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 174 - DNA, 8877 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagcccatgcggcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 175 - DNA, 5508 bp, Artificial Sequence
  Description of Artificial Sequence: Synthetic polynucleotide
atgagctcagagactggcccagtggctgtggaccccacattgagacggcggatcgagccccatgagtttgaggtattcttcgatccgagagagctccgcaaggagacctgcctgctttacgaaattaattgggggggccggcactccatttggcgacatacatcacagaacactaacaagcacgtcgaagtcaacttcatcgagaagttcacgacagaaagatatttctgtccgaacacaaggtgcagcattacctggtttctcagctggagccgcgaatgtagtagggccatcactgaattcctgtcaaggtatccccacgtcactctgtttatttacatcgcaaggctgtaccaccacgctgacccccgcaatcgacaaggcctgcgggatttgatctcttcaggtgtgactatccaaattatgactgagcaggagtcaggatactgctggagaaactttgtgaattatagcccgagtaatgaagcccactggcctaggtatccccatctgtgggtacgactgtacgttcttgaactgtactgcatcatactgggcctgcctccttgtctcaacattctgagaaggaagcagccacagctgacattctttaccatcgctcttcagtcttgtcattaccagcgactgcccccacacattctctgggccaccgggttgaaatctggtggttcttctggtggttctagcggcagcgagactcccgggacctcagagtccgccacacccgaaagttctggtggttcttctggtggttctgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgactctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctggaggatctggtggttctactaatctgtcagatattattgaaaaggagaccggtaagcaactggttatccaggaatccatcctcatgctcccagaggaggtggaagaagtcattgggaacaagccggaaagcgatatactcgtgcacaccgcctacgacgagagcaccgacgagaatgtcatgcttctgactagcgacgcccctgaatacaagccttgggctctggtcatacaggatagcaacggtgagaacaagattaagatgctctctggtggttctaaaaggacggcggacggatcagagttcgagagtccgaaaaaaaaacgaaaggtcgaataa

SEQ ID NO: 176 - DNA, 5514 bp, Artificial Sequence
  Description of Artificial Sequence: Synthetic polynucleotide
atgtcatccgaaaccgggccagtggccgtagacccaacactcaggaggcggatagaaccccatgagtttgaagtgttcttcgaccccagagagctgcgcaaagagacttgcctcctgtatgaaataaattgggggggtcgccattcaatttggaggcacactagccagaatactaacaaacacgtggaggtaaattttatcgagaagtttaccaccgaaagatacttttgccccaatacacggtgttcaattacctggtttctgtcatggagtccatgtggagaatgtagtagagcgataactgagttcctgtctcgatatcctcacgtcacgttgtttatatacatcgctcggctttatcaccatgcggacccgcggaacaggcaaggtcttcgggacctcatatcctctggggtgaccatccagataatgacggagcaagagagcggatactgctggcgaaactttgttaactacagcccaagcaatgaggcacactggcctagatatccgcatctctgggttcgactgtatgtccttgaactgtactgcataattctgggacttccgccatgcttgaacattctgcggcggaaacaaccacagctgacctttttcacgattgctctccaaagttgtcactaccagcgattgccaccccacatcttgtgggctactggactcaagtctggaggaagttcaggcggaagcagcgggtctgaaacgcccggaacctcagagagcgcaacgcccgaaagctctggagggtcaagtggtggtagtgataagaaatactccatcggcctcgccatcggtacgaattctgtcggttgggccgttatcaccgatgagtacaaggtcccttctaagaaattcaaggttttgggcaatacagaccgccattctataaaaaaaaacctgatcggcgcccttttgtttgacagtggtgagactgctgaagcgactcgcctgaagcgaactgccaggaggcggtatacgaggcgaaaaaaccgaatttgttacctccaggagattttctcaaatgaaatggccaaggtagatgatagtttttttcaccgcttggaagaaagttttctcgttgaggaggacaaaaagcacgagaggcacccaatctttggcaacatagtcgatgaggtcgcataccatgagaaatatcctacgatctatcatctccgcaagaagctggtcgatagcacggataaagctgacctccggctgatctaccttgctcttgctcacatgattaaattcaggggccatttcctgatagaaggagacctcaatcccgacaattctgatgtcgacaaactgtttattcagctcgttcagacctataatcaactctttgaggagaaccccatcaatgcttcaggggtggacgcaaaggccattttgtccgcgcgcttgagtaaatcacgacgcctcgagaatttgatagctcaactgccgggtgagaagaaaaacgggttgtttgggaatctcatagcgttgagtttgggacttacgccaaactttaagtctaactttgatttggccgaagatgccaaattgcagctgtccaaagatacctatgatgacgacttggataaccttcttgcgcagattggtgaccaatacgcggatctgtttcttgccgcaaaaaatctgtccgacgccatactcttgtccgatatactgcgcgtcaatactgagataactaaggctcccctcagcgcgtccatgattaaaagatacgatgagcaccaccaagatctcactctgttgaaagccctggttcgccagcagcttccagagaagtataaggagatatttttcgaccaatctaaaaacggctatgcgggttacattgacggtggcgcctctcaagaagaattctacaagtttataaagccgatacttgagaaaatggacggtacagaggaattgttggttaagctcaatcgcgaggacttgttgagaaagcagcgcacatttgacaatggtagtattccacaccagattcatctgggcgagttgcatgccattcttagaagacaagaagatttttatccgtttctgaaagataacagagaaaagattgaaaagatacttacctttcgcataccgtattatgtaggtcccctggctagagggaacagtcgcttcgcttggatgactcgaaaatcagaagaaacaataaccccctggaattttgaagaagtggtagataaaggtgcgagtgcccaatcttttattgagcggatgacaaattttgacaagaatctgcctaacgaaaaggtgcttcccaagcattcccttttgtatgaatactttacagtatataatgaactgactaaagtgaagtacgttaccgaggggatgcgaaagccagcttttctcagtggcgagcagaaaaaagcaatagttgacctgctgttcaagacgaataggaaggttaccgtcaaacagctcaaagaagattactttaaaaagatcgaatgttttgattcagttgagataagcggagtagaggatagatttaacgcaagtcttggaacttatcatgaccttttgaagatcatcaaggataaagattttttggacaacgaggagaatgaagatatcctggaagatatagtacttaccttgacgctttttgaagatcgagagatgatcgaggagcgacttaagacgtacgcacatctctttgacgataaggttatgaaacaattgaaacgccggcggtatactggctggggcaggctttctcgaaagctgattaatggtatccgcgataagcagtctggaaagacaatccttgactttctgaaaagtgatggatttgcaaatagaaactttatgcagcttatacatgatgactctttgacgttcaaggaagacatccagaaggcacaggtatccggccaaggggatagcctccatgaacacatagccaacctggccggctcaccagctattaaaaagggaatattgcaaaccgttaaggttgttgacgaactcgttaaggttatgggccgacacaaaccagagaatatcgtgattgagatggctagggagaatcagaccactcaaaaaggtcagaaaaattctcgcgaaaggatgaagcgaattgaagagggaatcaaagaacttggctctcaaattttgaaagagcacccggtagaaaacactcagctgcagaatgaaaagctgtatctgtattatctgcagaatggtcgagatatgtacgttgatcaggagctggatatcaataggctcagtgactacgatgtcgaccacatcgttcctcaatctttcctgaaagatgactctatcgacaacaaagtgttgacgcgatcagataagaaccggggaaaatccgacaatgtaccctcagaagaagttgtcaagaagatgaaaaactattggagacaattgctgaacgccaagctcataacacaacgcaagttcgataacttgacgaaagccgaaagaggtgggttgtcagaattggacaaagctggctttattaagcgccaattggtggagacccggcagattacgaaacacgtagcacaaattttggattcacgaatgaataccaaatacgacgaaaacgacaaattgatacgcgaggtgaaagtgattacgcttaagagtaagttggtttccgatttcaggaaggattttcagttttacaaagtaagagaaataaacaactaccaccacgcccatgatgcttacctcaacgcggtagttggcacagctcttatcaaaaaatatccaaagctggaaagcgagttcgtttacggtgactataaagtatacgacgttcggaagatgatagccaaatcagagcaggaaattgggaaggcaaccgcaaaatacttcttctattcaaacatcatgaacttctttaagacggagattacgctcgcgaacggcgaaatacgcaagaggcccctcatagagactaacggcgaaaccggggagatcgtatgggacaaaggacgggactttgcgaccgttagaaaagtactttcaatgccacaagtgaatattgttaaaaagacagaagtacaaacaggggggttcagtaaggaatccattttgcccaagcggaacagtgataaattgatagcaaggaaaaaagattgggaccctaagaagtacggtggtttcgactctcctaccgttgcatattcagtccttgtagttgcgaaagtggaaaaggggaaaagtaagaagcttaagagtgttaaagagcttctgggcataaccataatggaacggtctagcttcgagaaaaatccaattgactttctcgaggctaaaggttacaaggaggtaaaaaaggacctgataattaaactcccaaagtacagtctcttcgagttggagaatgggaggaagagaatgttggcatctgcaggggagctccaaaaggggaacgagctggctctgccttcaaaatacgtgaactttctgtacctggccagccactacgagaaactcaagggttctcctgaggataacgagcagaaacagctgtttgtagagcagcacaagcattacctggacgagataattgagcaaattagtgagttctcaaaaagagtaatccttgcagacgcgaatctggataaagttctttccgcctataataagcaccgggacaagcctatacgagaacaagccgagaacatcattcacctctttacccttactaatctgggcgcgccggccgccttcaaatacttcgacaccacgatagacaggaaaaggtatacgagtaccaaagaagtacttgacgccactctcatccaccagtctataacagggttgtacgaaacgaggatagatttgtcccagctcggcggcgactcaggagggtcaggcggctccggtggatcaacgaatctttccgacataatcgagaaagaaaccggcaaacagttggtgatccaagaatcaatcctgatgctgcctgaagaagtagaagaggtgattggcaacaaacctgagtctgacattcttgtccacaccgcgtatgacgagagcacggacgagaacgttatgcttctcactagcgacgcccctgagtataaaccatgggcgctggtcatccaagattccaatggggaaaacaagattaagatgcttagtggtgggtctggagggagcggtgggtccacgaacctcagcgacattattgaaaaagagactggtaaacaacttgtaatacaagagtctattctgatgttgcctgaagaggtggaggaggtgattgggaacaaaccggagtctgatatacttgttcataccgcctatgacgaatctactgatgagaatgtgatgcttttaacgtcagacgctcccgagtacaaaccctgggctctggtgattcaggacagcaatggtgagaataagattaaaatgttgagtgggggctcaaagcgcacggctgacggtagcgaatttgagagccccaaaaaaaaacgaaaggtcgaataa

SEQ ID NO: 177 - DNA, 5514 bp, Artificial Sequence
  Description of Artificial Sequence: Synthetic polynucleotide
atgagcagcgagacaggccctgtggctgtggatcctacactgcggagaagaatcgagccccacgagttcgaggtgttcttcgaccccagagagctgcggaaagagacatgcctgctgtacgagatcaactggggcggcagacactctatctggcggcacacaagccagaacaccaacaagcacgtggaagtgaactttatcgagaagtttacgaccgagcggtacttctgccccaacaccagatgcagcatcacctggtttctgagctggtccccttgcggcgagtgcagcagagccatcaccgagtttctgtccagatatccccacgtgaccctgttcatctatatcgcccggctgtaccaccacgccgatcctagaaatagacagggactgcgcgacctgatcagcagcggagtgaccatccagatcatgaccgagcaagagagcggctactgctggcggaacttcgtgaactacagccccagcaacgaagcccactggcctagatatcctcacctgtgggtccgactgtacgtgctggaactgtactgcatcatcctgggcctgcctccatgcctgaacatcctgagaagaaagcagcctcagctgaccttcttcacaatcgccctgcagagctgccactaccagagactgcctccacacatcctgtgggccaccggacttaagagcggaggatctagcggcggctctagcggatctgagacacctggcacaagcgagtctgccacacctgagagtagcggcggatcttctggcggctccgacaagaagtactctatcggactggccatcggcaccaactctgttggatgggccgtgatcaccgacgagtacaaggtgcccagcaagaaattcaaggtgctgggcaacaccgaccggcacagcatcaagaagaatctgatcggcgccctgctgttcgactctggcgaaacagccgaagccaccagactgaagagaaccgccaggcggagatacacccggcggaagaaccggatctgctacctgcaagagatcttcagcaacgagatggccaaggtggacgacagcttcttccacagactggaagagtccttcctggtggaagaggacaagaagcacgagcggcaccccatcttcggcaacatcgtggatgaggtggcctaccacgagaagtaccccaccatctaccacctgagaaagaaactggtggacagcaccgacaaggccgacctgagactgatctacctggctctggcccacatgatcaagttccggggccactttctgatcgagggcgatctgaaccccgacaacagcgacgtggacaagctgttcatccagctggtgcagacctacaaccagctgttcgaggaaaaccccatcaacgcctctggcgtggacgccaaggctatcctgtctgccagactgagcaagagcagaaggctggaaaacctgatcgcccagctgcctggcgagaagaagaatggcctgttcggcaacctgattgccctgagcctgggactgacccctaacttcaagagcaacttcgacctggccgaggatgccaaactgcagctgagcaaggacacctacgacgacgacctggacaatctgctggcccagatcggcgatcagtacgccgacttgtttctggccgccaagaacctgtccgacgccatcctgctgagcgatatcctgagagtgaacaccgagatcacaaaggcccctctgagcgcctctatgatcaagagatacgacgagcaccaccaggatctgaccctgctgaaggccctcgttagacagcagctgccagagaagtacaaagagattttcttcgatcagtccaagaacggctacgccggctacattgatggcggagccagccaagaggaattctacaagttcatcaagcccatcctggaaaagatggacggcaccgaggaactgctggtcaagctgaacagagaggacctgctgcggaagcagcggaccttcgacaatggctctatccctcaccagatccacctgggagagctgcacgccattctgcggagacaagaggacttttacccattcctgaaggacaaccgggaaaagatcgagaagatcctgaccttcaggatcccctactacgtgggaccactggccagaggcaatagcagattcgcctggatgaccagaaagagcgaggaaaccatcacaccctggaacttcgaggaagtggtggacaagggcgccagcgctcagtccttcatcgagcggatgaccaacttcgataagaacctgcctaacgagaaggtgctgcccaagcactccctgctgtatgagtacttcaccgtgtacaacgagctgaccaaagtgaaatacgtgaccgagggaatgagaaagcccgcctttctgagcggcgagcagaaaaaggccattgtggatctgctgttcaagaccaaccggaaagtgaccgtgaagcagctgaaagaggactacttcaagaaaatcgagtgcttcgacagcgtggaaatcagcggcgtggaagatcggttcaatgccagcctgggcacataccacgacctgctgaaaattatcaaggacaaggacttcctggacaacgaagagaacgaggacattctcgaggacatcgtgctgaccctgacactgtttgaggacagagagatgatcgaggaacggctgaaaacatacgcccacctgttcgacgacaaagtgatgaagcaactgaagcggaggcggtacacaggctggggcagactgtctcggaagctgatcaacggcatccgggataagcagtccggcaagacaatcctggatttcctgaagtccgacggcttcgccaacagaaacttcatgcagctgatccacgacgacagcctgacctttaaagaggacatccagaaagcccaggtgtccggccaaggcgattctctgcacgagcacattgccaacctggccggatctcccgccattaagaagggcatcctgcagacagtgaaggtggtggacgagcttgtgaaagtgatgggcagacacaagcccgagaacatcgtgatcgaaatggccagagagaaccagaccacacagaagggccagaagaacagccgcgagagaatgaagcggatcgaagagggcatcaaagagctgggcagccagatcctgaaagaacaccccgtggaaaacacccagctgcagaacgagaagctgtacctgtactacctgcagaatggacgggatatgtacgtggaccaagagctggacatcaaccggctgagcgactacgatgtggaccatatcgtgccccagagctttctgaaggacgactccatcgataacaaggtcctgaccagaagcgacaagaaccggggcaagagcgataacgtgccctccgaagaggtggtcaagaagatgaagaactactggcgacagctgctgaacgccaagctgattacccagcggaagttcgataacctgaccaaggccgagagaggcggcctgagcgaacttgataaggccggcttcattaagcggcagctggtggaaacccggcagatcaccaaacacgtggcacagattctggactcccggatgaacactaagtacgacgagaatgacaagctgatccgggaagtgaaagtcatcaccctgaagtctaagctggtgtccgatttccggaaggatttccagttctacaaagtgcgggaaatcaacaactaccatcacgcccacgacgcctacctgaatgccgttgttggaacagccctgatcaagaagtatcccaagctggaaagcgagttcgtgtacggcgactacaaggtgtacgacgtgcggaagatgatcgccaagagcgaacaagagatcggcaaggctaccgccaagtactttttctacagcaacatcatgaactttttcaagacagagatcaccctggccaacggcgagatccggaaaagacccctgatcgagacaaacggcgaaaccggggagatcgtgtgggataagggcagagattttgccacagtgcggaaagtgctgagcatgccccaagtgaatatcgtgaagaaaaccgaggtgcagacaggcggcttcagcaaagagtctatcctgcctaagcggaacagcgataagctgatcgccagaaagaaggactgggaccctaagaagtacggcggcttcgatagccctaccgtggcctattctgtgctggtggtggccaaagtggaaaagggcaagtccaaaaagctcaagagcgtgaaagagctgctggggatcaccatcatggaaagaagcagctttgagaagaacccgatcgactttctggaagccaagggctacaaagaagtcaagaaggacctcatcatcaagctccccaagtacagcctgttcgagctggaaaatggccggaagcggatgctggcctcagcaggcgaactgcagaaaggcaatgaactggccctgcctagcaaatacgtcaacttcctgtacctggccagccactatgagaagctgaagggcagccccgaggacaatgagcaaaagcagctgtttgtggaacagcacaagcactacctggacgagatcatcgagcagatcagcgagttctccaagagagtgatcctggccgacgctaacctggataaggtgctgtctgcctataacaagcaccgggacaagcctatcagagagcaggccgagaatatcatccacctgtttaccctgaccaacctgggagcccctgccgccttcaagtacttcgacaccaccatcgaccggaagaggtacaccagcaccaaagaggtgctggacgccacactgatccaccagtctatcaccggcctgtacgaaacccggatcgacctgtctcagctcggcggcgattctggtggttctggcggaagtggcggatccaccaatctgagcgacatcatcgaaaaagagacaggcaagcagctcgtgatccaagaatccatcctgatgctgcctgaagaggttgaggaagtgatcggcaacaagcctgagtccgacatcctggtgcacaccgcctacgatgagagcaccgatgagaacgtcatgctgctgacaagcgacgcccctgagtacaagccttgggctctcgtgattcaggacagcaatggggagaacaagatcaagatgctgagcggaggtagcggaggcagtggcggaagcacaaacctgtctgatatcattgaaaaagaaaccgggaagcaactggtcattcaagagtccattctcatgctcccggaagaagtcgaggaagtcattggaaacaaacccgagagcgatattctggtccacacagcctatgacgagtctacagacgaaaacgtgatgctcctgacctctgacgctcccgagtataagccctgggcacttgttatccaggactctaacggggaaaacaaaatcaaaatgttgtccggcggcagcaagcggacagccgatggatctgagttcgagagccccaagaagaaacggaaggtggagtaa

SEQ ID NO: 178 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 179 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 180 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 181 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 182 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 183 - protein, 1368 aa, Streptococcus pyogenes [sequence omitted]

SEQ ID NO: 184 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 185 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 186 - protein, 1367 aa, Streptococcus pyogenes
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 187 - protein, 1367 aa, Artificial Sequence
  Description of Artificial Sequence: Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 188 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 189 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 190 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 191 - protein, 986 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 192 - protein, 1210 aa, Unknown
  Description of Unknown: uncultured Parcubacteria group bacterium sequence
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 193 - DNA, 306 bp, Unknown
  Description of Unknown: DnaE Intein-N sequence
tgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 194 - protein, 102 aa, Unknown
  Description of Unknown: DnaE Intein-N sequence
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 195 - DNA, 108 bp, Unknown
  Description of Unknown: DnaE Intein-C sequence
atgatcaagatagctacaaggaagtatcttggcaaacaaaacgtttatgatattggagtcgaaagagatcacaactttgctctgaagaacggattcatagcttctaat

SEQ ID NO: 196 - protein, 36 aa, Unknown
  Description of Unknown: Intein-C sequence
MIKIATRKYLGKQNVYDIGVERDHNFALKNGFIASN

SEQ ID NO: 197 - DNA, 303 bp, Artificial Sequence
  Description of Artificial Sequence: Synthetic polynucleotide
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 198 - protein, 101 aa, Artificial Sequence
  Description of Artificial Sequence: Synthetic polypeptide
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 199 - DNA, 159 bp, Artificial Sequence
  Description of Artificial Sequence: Synthetic polynucleotide
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 200 - protein, 53 aa, Artificial Sequence
  Description of Artificial Sequence: Synthetic polypeptide
MKRTADGSEFESPKKKRKVKIISRKSLGTQNVYDIGVEKDHNFLLKNGLVASN

SEQ ID NO: 201 - protein, 24 aa, Artificial Sequence
  Description of Artificial Sequence: Synthetic peptide
SGGSSGSETPGTSESATPESSGGS

SEQ ID NO: 202 - protein, 32 aa, Artificial Sequence
  Description of Artificial Sequence: Synthetic polypeptide
SGGSSGGSSGSETPGTSESATPESSGGSSGGS

SEQ ID NO: 203 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 204 - protein, 16 aa, Artificial Sequence
  Description of Artificial Sequence: Synthetic peptide
SGSETPGTSESATPES

SEQ ID NO: 205 - protein, 4 aa, Artificial Sequence
  Description of Artificial Sequence: Synthetic peptide
SGGS

SEQ ID NO: 206 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 207 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 208 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 209 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 210 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 211 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 212 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  MISC_FEATURE (1)..(60): This sequence may encompass 1-30 "Xaa Pro" repeating units
XPXPXPXPXPXPXPXPXPXPXPXPXPXPXPXPXPXPXPXPXPXPXPXPXPXPXPXPXPXP

SEQ ID NO: 213 - protein, 24 aa, Artificial Sequence
  Description of Artificial Sequence: Synthetic peptide
SGGSSGGSSGSETPGTSESATPES

SEQ ID NO: 214 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 215 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 216 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 217 - protein, 18 aa, Artificial Sequence
  Description of Artificial Sequence: Synthetic peptide
KRTADGSEFESPKKKRKV

SEQ ID NO: 218 - protein, 16 aa, Artificial Sequence
  Description of Artificial Sequence: Synthetic peptide
KRPAATKKAGQAKKKK

SEQ ID NO: 219 - protein, 17 aa, Artificial Sequence
  Description of Artificial Sequence: Synthetic peptide
KKTELQTTNAENKTKKL

SEQ ID NO: 220 - protein, 19 aa, Artificial Sequence
  Description of Artificial Sequence: Synthetic peptide
KRGINDRNFWRGENGRKTR

SEQ ID NO: 221 - protein, 16 aa, Artificial Sequence
  Description of Artificial Sequence: Synthetic peptide
RKSGKIAAIVVKRPRK

SEQ ID NO: 222 - protein, 7 aa, Artificial Sequence
  Description of Artificial Sequence: Synthetic peptide
PKKKRKV

SEQ ID NO: 223 - protein, 30 aa, Artificial Sequence
  Description of Artificial Sequence: Synthetic polypeptide
MDSLLMNRRKFLYQFKNVRWAKGRRETYLC

SEQ ID NO: 224 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 225 - protein, 1368 aa, Artificial Sequence [sequence omitted]

SEQ ID NO: 226 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 227 - protein, 345 aa, Sulfolobus islandicus; identical to SEQ ID NO: 190

SEQ ID NO: 228 - protein, 987 aa, Unknown
  Description of Unknown: Deltaproteobacteria CasX  sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDFAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 229 - protein, 1210 aa, Unknown; identical to SEQ ID NO: 192
  Description of Unknown: uncultured Parcubacteria group bacterium sequence

SEQ ID NO: 230 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 231 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 232 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 233 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 234 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 235 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 236 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 237 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 238 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 239 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 240 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 241 - protein, 1129 aa, Alicyclobacillus acidiphilus
MAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDI

SEQ ID NO: 242 - protein, 1140 aa, Bacillus hisashii
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 243 - RNA, 120 nt, Artificial Sequence
  Description of Artificial Sequence: Synthetic polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 244 - DNA, 47 bp, Artificial Sequence
  Description of Artificial Sequence: Synthetic oligonucleotide
gggaaataagagagaaaagaagagtaagaagaaatataagagccacc

SEQ ID NO: 245 - DNA, 101 bp, Artificial Sequence
  Description of Artificial Sequence: Synthetic polynucleotide
gctggagcctcggtggccatgcttcttgccccttgggcctccccccagcccctcctccccttcctgcacccgtacccccgtggtctttgaataaagtctga

SEQ ID NO: 246 - DNA, 3420 bp, Artificial Sequence
  Description of Artificial Sequence: Synthetic polynucleotide
atggccccaaagaagaagcggaaggtcggtatccacggagtcccagcagccgccaccagatccttcatcctgaagatcgagcccaacgaggaagtgaagaaaggcctctggaaaacccacgaggtgctgaaccacggaatcgcctactacatgaatatcctgaagctgatccggcaagaggccatctacgagcaccacgagcaggaccccaagaatcccaagaaggtgtccaaggccgagatccaggccgagctgtgggatttcgtgctgaagatgcagaagtgcaacagcttcacacacgaggtggacaaggacgaggtgttcaacatcctgagagagctgtacgaggaactggtgcccagcagcgtggaaaagaagggcgaagccaaccagctgagcaacaagtttctgtaccctctggtggaccccaacagccagtctggaaagggaacagccagcagcggcagaaagcccagatggtacaacctgaagattgccggcgatccctcctgggaagaagagaagaagaagtgggaagaagataagaaaaaggacccgctggccaagatcctgggcaagctggctgagtacggactgatccctctgttcatcccctacaccgacagcaacgagcccatcgtgaaagaaatcaagtggatggaaaagtcccggaaccagagcgtgcggcggctggataaggacatgttcattcaggccctggaacggttcctgagctgggagagctggaacctgaaagtgaaagaggaatacgagaaggtcgagaaagagtacaagaccctggaagagaggatcaaagaggacatccaggctctgaaggctctggaacagtatgagaaagagcggcaagaacagctgctgcgggacaccctgaacaccaacgagtaccggctgagcaagagaggccttagaggctggcgggaaatcatccagaaatggctgaaaatggacgagaacgagccctccgagaagtacctggaagtgttcaaggactaccagcggaagcaccctagagaggccggcgattacagcgtgtacgagttcctgtccaagaaagagaaccacttcatctggcggaatcaccctgagtacccctacctgtacgccaccttctgcgagatcgacaagaaaaagaaggacgccaagcagcaggccaccttcacactggccgatcctatcaatcaccctctgtgggtccgattcgaggaaagaagcggcagcaacctgaacaagtacagaatcctgaccgagcagctgcacaccgagaagctgaagaaaaagctgacagtgcagctggaccggctgatctaccctacagaatctggcggctgggaagagaagggcaaagtggacattgtgctgctgcccagccggcagttctacaaccagatcttcctggacatcgaggaaaagggcaagcacgccttcacctacaaggatgagagcatcaagttccctctgaagggcacactcggcggagccagagtgcagttcgacagagatcacctgagaagataccctcacaaggtggaaagcggcaacgtgggcagaatctacttcaacatgaccgtgaacatcgagcctacagagtccccagtgtccaagtctctgaagatccaccgggacgacttccccaaggtggtcaacttcaagcccaaagaactgaccgagtggatcaaggacagcaagggcaagaaactgaagtccggcatcgagtccctggaaatcggcctgagagtgatgagcatcgacctgggacagagacaggccgctgccgcctctattttcgaggtggtggatcagaagcccgacatcgaaggcaagctgtttttcccaatcaagggcaccgagctgtatgccgtgcacagagccagcttcaacatcaagctgcccggcgagacactggtcaagagcagagaagtgctgcggaaggccagagaggacaatctgaaactgatgaaccagaagctcaacttcctgcggaacgtgctgcacttccagcagttcgaggacatcaccgagagagagaagcgggtcaccaagtggatcagcagacaagagaacagcgacgtgcccctggtgtaccaggatgagctgatccagatccgcgagctgatgtacaagccttacaaggactgggtcgccttcctgaagcagctccacaagagactggaagtcgagatcggcaaagaagtgaagcactggcggaagtccctgagcgacggaagaaagggcctgtacggcatctccctgaagaacatcgacgagatcgatcggacccggaagttcctgctgagatggtccctgaggcctaccgaacctggcgaagtgcgtagactggaacccggccagagattcgccatcgaccagctgaatcacctgaacgccctgaaagaagatcggctgaagaagatggccaacaccatcatcatgcacgccctgggctactgctacgacgtgcggaagaagaaatggcaggctaagaaccccgcctgccagatcatcctgttcgaggatctgagcaactacaacccctacgaggaaaggtcccgcttcgagaacagcaagctcatgaagtggtccagacgcgagatccccagacaggttgcactgcagggcgagatctatggcctgcaagtgggagaagtgggcgctcagttcagcagcagattccacgccaagacaggcagccctggcatcagatgtagcgtcgtgaccaaagagaagctgcaggacaatcggttcttcaagaatctgcagagagagggcagactgaccctggacaaaatcgccgtgctgaaagagggcgatctgtacccagacaaaggcggcgagaagttcatcagcctgagcaaggatcggaagtgcgtgaccacacacgccgacatcaacgccgctcagaacctgcagaagcggttctggacaagaacccacggcttctacaaggtgtactgcaaggcctaccaggtggacggccagaccgtgtacatccctgagagcaaggaccagaagcagaagatcatcgaagagttcggcgagggctacttcattctgaaggacggggtgtacgaatgggtcaacgccggcaagctgaaaatcaagaagggcagctccaagcagagcagcagcgagctggtggatagcgacatcctgaaagacagcttcgacctggcctccgagctgaaaggcgaaaagctgatgctgtacagggaccccagcggcaatgtgttccccagcgacaaatggatggccgctggcgtgttcttcggaaagctggaacgcatcctgatcagcaagctgaccaaccagtactccatcagcaccatcgaggacgacagcagcaagcagtctatgaaaaggccggcggccacgaaaaaggccggccaggcaaaaaagaaaaag

SEQ ID NO: 247 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 248 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 249 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 250 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 251 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 252 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 253 - protein, 29 aa, Artificial Sequence
  Description of Artificial Sequence: Synthetic peptide
PKKKRKVEGADKRTADGSEFESPKKKRKV

SEQ ID NO: 254 - protein, 23 aa, Artificial Sequence
  Description of Artificial Sequence: Synthetic peptide
RKSGKIAAIVVKRPRKPKKKRKV

SEQ ID NO: 255 - protein, 167 aa, Unknown
  Description of Unknown: TadA sequence
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 256 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 257 - protein, 167 aa, Escherichia coli; identical to SEQ ID NO: 164

SEQ ID NO: 258 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 259 - DNA, 766 bp, Petromyzon marinus
tgacacgacacagccgtgtatatgaggaagggtagctggatggggggggggggaatacgttcagagaggacattagcgagcgtcttgttggtggccttgagtctagacacctgcagacatgaccgacgctgagtacgtgagaatccatgagaagttggacatctacacgtttaagaaacagtttttcaacaacaaaaaatccgtgtcgcatagatgctacgttctctttgaattaaaacgacggggtgaacgtagagcgtgtttttggggctatgctgtgaataaaccacagagcgggacagaacgtggaattcacgccgaaatctttagcattagaaaagtcgaagaatacctgcgcgacaaccccggacaattcacgataaattggtactcatcctggagtccttgtgcagattgcgctgaaaagatcttagaatggtataaccaggagctgcgggggaacggccacactttgaaaatctgggcttgcaaactctattacgagaaaaatgcgaggaatcaaattgggctgtggaacctcagagataacggggttgggttgaatgtaatggtaagtgaacactaccaatgttgcaggaaaatattcatccaatcgtcgcacaatcaattgaatgagaatagatggcttgagaagactttgaagcgagctgaaaaacgacggagcgagttgtccattatgattcaggtaaaaatactccacaccactaagagtcctgctgtttaagaggctatgcggatggttttc

SEQ ID NO: 260 - protein, 145 aa, Homo sapiens
MDSLLMNRRKFLYQFKNVRWAKGRRETYLCYVVKRRDSATSFSLDFGYLRNKNGCHVELLFLRYISDWDLDPGRCYRVTWFTSWSPCYDCARHVADFLRGNPNLSLRIFTARLYFCEDRKAEPEGLRRLHRAGVQIAIMTFKAPV

SEQ ID NO: 261 - DNA, 10681 bp, Homo sapiens
agagaaccatcattaattgaagtgagatttttctggcctgagacttgcagggaggcaagaagacactctggacaccactatggacaggtaaagaggcagtcttctcgtgggtgattgcactggccttcctctcagagcaaatctgagtaatgagactggtagctatccctttctctcatgtaactgtctgactgataagatcagcttgatcaatatgcatatatattttttgatctgtctccttttcttctattcagatcttatacgctgtcagcccaattctttctgtttcagacttctcttgatttccctctttttcatgtggcaaaagaagtagtgcgtacaatgtactgattcgtcctgagatttgtaccatggttgaaactaatttatggtaataatattaacatagcaaatctttagagactcaaatcatgaaaaggtaatagcagtactgtactaaaaacggtagtgctaattttcgtaataattttgtaaatattcaacagtaaaacaacttgaagacacactttcctagggaggcgttactgaaataatttagctatagtaagaaaatttgtaattttagaaatgccaagcattctaaattaattgcttgaaagtcactatgattgtgtccattataaggagacaaattcattcaagcaagttatttaatgttaaaggcccaattgttaggcagttaatggcacttttactattaactaatctttccatttgttcagacgtagcttaacttacctcttaggtgtgaatttggttaaggtcctcataatgtctttatgtgcagtttttgataggttattgtcatagaacttattctattcctacatttatgattactatggatgtatgagaataacacctaatccttatactttacctcaatttaactcctttataaagaacttacattacagaataaagattttttaaaaatatatttttttgtagagacagggtcttagcccagccgaggctggtctctaagtcctggcccaagcgatcctcctgcctgggcctcctaaagtgctggaattatagacatgagccatcacatccaatatacagaataaagatttttaatggaggatttaatgttcttcagaaaattttcttgaggtcagacaatgtcaaatgtctcctcagtttacactgagattttgaaaacaagtctgagctataggtccttgtgaagggtccattggaaatacttgttcaaagtaaaatggaaagcaaaggtaaaatcagcagttgaaattcagagaaagacagaaaaggagaaaagatgaaattcaacaggacagaagggaaatatattatcattaaggaggacagtatctgtagagctcattagtgatggcaaaatgacttggtcaggattatttttaacccgcttgtttctggtttgcacggctggggatgcagctagggttctgcctcagggagcacagctgtccagagcagctgtcagcctgcaagcctgaaacactccctcggtaaagtccttcctactcaggacagaaatgacgagaacagggagctggaaacaggcccctaaccagagaagggaagtaatggatcaacaaagttaactagcaggtcaggatcacgcaattcatttcactctgactggtaacatgtgacagaaacagtgtaggcttattgtattttcatgtagagtaggacccaaaaatccacccaaagtcctttatctatgccacatccttcttatctatacttccaggacactttttcttccttatgataaggctctctctctctccacacacacacacacacacacacacacacacacacacacacacacaaacacacaccccgccaaccaaggtgcatgtaaaaagatgtagattcctctgcctttctcatctacacagcccaggagggtaagttaatataagagggatttattggtaagagatgatgcttaatctgtttaacactgggcctcaaagagagaatttcttttcttctgtacttattaagcacctattatgtgttgagcttatatatacaaagggttattatatgctaatatagtaatagtaatggtggttggtactatggtaattaccataaaaattattatccttttaaaataaagctaattattattggatcttttttagtattcattttatgttttttatgtttttgattttttaaaagacaatctcaccctgttacccaggctggagtgcagtggtgcaatcatagctttctgcagtcttgaactcctgggctcaagcaatcctcctgccttggcctcccaaagtgttgggatacagtcatgagccactgcatctggcctaggatccatttagattaaaatatgcattttaaattttaaaataatatggctaatttttaccttatgtaatgtgtatactggcaataaatctagtttgctgcctaaagtttaaagtgctttccagtaagcttcatgtacgtgaggggagacatttaaagtgaaacagacagccaggtgtggtggctcacgcctgtaatcccagcactctgggaggctgaggtgggtggatcgcttgagccctggagttcaagaccagcctgagcaacatggcaaaacgctgtttctataacaaaaattagccgggcatggtggcatgtgcctgtggtcccagctactagggggctgaggcaggagaatcgttggagcccaggaggtcaaggctgcactgagcagtgcttgcgccactgcactccagcctgggtgacaggaccagaccttgcctcaaaaaaataagaagaaaaattaaaaataaatggaaacaactacaaagagctgttgtcctagatgagctacttagttaggctgatattttggtatttaacttttaaagtcagggtctgtcacctgcactacattattaaaatatcaattctcaatgtatatccacacaaagactggtacgtgaatgttcatagtacctttattcacaaaaccccaaagtagagactatccaaatatccatcaacaagtgaacaaataaacaaaatgtgctatatccatgcaatggaataccaccctgcagtacaaagaagctacttggggatgaatcccaaagtcatgacgctaaatgaaagagtcagacatgaaggaggagataatgtatgccatacgaaattctagaaaatgaaagtaacttatagttacagaaagcaaatcagggcaggcatagaggctcacacctgtaatcccagcactttgagaggccacgtgggaagattgctagaactcaggagttcaagaccagcctgggcaacacagtgaaactccattctccacaaaaatgggaaaaaaagaaagcaaatcagtggttgtcctgtggggaggggaaggactgcaaagagggaagaagctctggtggggtgagggtggtgattcaggttctgtatcctgactgtggtagcagtttggggtgtttacatccaaaaatattcgtagaattatgcatcttaaatgggtggagtttactgtatgtaaattatacctcaatgtaagaaaaaataatgtgtaagaaaactttcaattctcttgccagcaaacgttattcaaattcctgagccctttacttcgcaaattctctgcacttctgccccgtaccattaggtgacagcactagctccacaaattggataaatgcatttctggaaaagactagggacaaaatccaggcatcacttgtgctttcatatcaaccatgctgtacagcttgtgttgctgtctgcagctgcaatggggactcttgatttctttaaggaaacttgggttaccagagtatttccacaaatgctattcaaattagtgcttatgatatgcaagacactgtgctaggagccagaaaacaaagaggaggagaaatcagtcattatgtgggaacaacatagcaagatatttagatcattttgactagttaaaaaagcagcagagtacaaaatcacacatgcaatcagtataatccaaatcatgtaaatatgtgcctgtagaaagactagaggaataaacacaagaatcttaacagtcattgtcattagacactaagtctaattattattattagacactatgatatttgagatttaaaaaatctttaatattttaaaatttagagctcttctatttttccatagtattcaagtttgacaatgatcaagtattactctttctttttttttttttttttttttttttgagatggagttttggtcttgttgcccatgctggagtggaatggcatgaccatagctcactgcaacctccacctcctgggttcaagcaaagctgtcgcctcagcctcccgggtagatgggattacaggcgcccaccaccacactcggctaatgtttgtatttttagtagagatggggtttcaccatgttggccaggctggtctcaaactcctgacctcagaggatccacctgcctcagcctcccaaagtgctgggattacagatgtaggccactgcgcccggccaagtattgctcttatacattaaaaaacaggtgtgagccactgcgcccagccaggtattgctcttatacattaaaaaataggccggtgcagtggctcacgcctgtaatcccagcactttgggaagccaaggcgggcagaacacccgaggtcaggagtccaaggccagcctggccaagatggtgaaaccccgtctctattaaaaatacaaacattacctgggcatgatggtgggcgcctgtaatcccagctactcaggaggctgaggcaggaggatccgcggagcctggcagatctgcctgagcctgggaggttgaggctacagtaagccaagatcatgccagtatacttcagcctgggcgacaaagtgagaccgtaacaaaaaaaaaaaaatttaaaaaaagaaatttagatcaagatccaactgtaaaaagtggcctaaacaccacattaaagagtttggagtttattctgcaggcagaagagaaccatcagggggtcttcagcatgggaatggcatggtgcacctggtttttgtgagatcatggtggtgacagtgtggggaatgttattttggagggactggaggcagacagaccggttaaaaggccagcacaacagataaggaggaagaagatgagggcttggaccgaagcagagaagagcaaacagggaaggtacaaattcaagaaatattggggggtttgaatcaacacatttagatgattaattaaatatgaggactgaggaataagaaatgagtcaaggatggttccaggctgctaggctgcttacctgaggtggcaaagtcgggaggagtggcagtttaggacagggggcagttgaggaatattgttttgatcattttgagtttgaggtacaagttggacacttaggtaaagactggaggggaaatctgaatatacaattatgggactgaggaacaagtttattttattttttgtttcgttttcttgttgaagaacaaatttaattgtaatcccaagtcatcagcatctagaagacagtggcaggaggtgactgtcttgtgggtaagggtttggggtccttgatgagtatctctcaattggccttaaatataagcaggaaaaggagtttatgatggattccaggctcagcagggctcaggagggctcaggcagccagcagaggaagtcagagcatcttctttggtttagcccaagtaatgacttccttaaaaagctgaaggaaaatccagagtgaccagattataaactgtactcttgcattttctctccctcctctcacccacagcctcttgatgaaccggaggaagtttctttaccaattcaaaaatgtccgctgggctaagggtcggcgtgagacctacctgtgctacgtagtgaagaggcgtgacagtgctacatccttttcactggactttggttatcttcgcaataaggtatcaattaaagtcggctttgcaagcagtttaatggtcaactgtgagtgcttttagagccacctgctgatggtattacttccatccttttttggcatttgtgtctctatcacattcctcaaatccttttttttatttctttttccatgtccatgcacccatattagacatggcccaaaatatgtgatttaattcctccccagtaatgctgggcaccctaataccactccttccttcagtgccaagaacaactgctcccaaactgtttaccagctttcctcagcatctgaattgcctttgagattaattaagctaaaagcatttttatatgggagaatattatcagcttgtccaagcaaaaattttaaatgtgaaaaacaaattgtgtcttaagcatttttgaaaattaaggaagaagaatttgggaaaaaattaacggtggctcaattctgtcttccaaatgatttcttttccctcctactcacatgggtcgtaggccagtgaatacattcaacatggtgatccccagaaaactcagagaagcctcggctgatgattaattaaattgatctttcggctacccgagagaattacatttccaagagacttcttcaccaaaatccagatgggtttacataaacttctgcccacgggtatctcctctctcctaacacgctgtgacgtctgggcttggtggaatctcagggaagcatccgtggggtggaaggtcatcgtctggctcgttgtttgatggttatattaccatgcaattttctttgcctacatttgtattgaatacatcccaatctccttcctattcggtgacatgacacattctatttcagaaggctttgattttatcaagcactttcatttacttctcatggcagtgcctattacttctcttacaatacccatctgtctgctttaccaaaatctatttccccttttcagatcctcccaaatggtcctcataaactgtcctgcctccacctagtggtccaggtatatttccacaatgttacatcaacaggcacttctagccattttccttctcaaaaggtgcaaaaagcaacttcataaacacaaattaaatcttcggtgaggtagtgtgatgctgcttcctcccaactcagcgcacttcgtcttcctcattccacaaaaacccatagccttccttcactctgcaggactagtgctgccaagggttcagctctacctactggtgtgctcttttgagcaagttgcttagcctctctgtaacacaaggacaatagctgcaagcatccccaaagatcattgcaggagacaatgactaaggctaccagagccgcaataaaagtcagtgaattttagcgtggtcctctctgtctctccagaacggctgccacgtggaattgctcttcctccgctacatctcggactgggacctagaccctggccgctgctaccgcgtcacctggttcacctcctggagcccctgctacgactgtgcccgacatgtggccgactttctgcgagggaaccccaacctcagtctgaggatcttcaccgcgcgcctctacttctgtgaggaccgcaaggctgagcccgaggggctgcggcggctgcaccgcgccggggtgcaaatagccatcatgaccttcaaaggtgcgaaagggccttccgcgcaggcgcagtgcagcagcccgcattcgggattgcgatgcggaatgaatgagttagtggggaagctcgaggggaagaagtgggcggggattctggttcacctctggagccgaaattaaagattagaagcagagaaaagagtgaatggctcagagacaaggccccgaggaaatgagaaaatggggccagggttgcttctttcccctcgatttggaacctgaactgtcttctacccccatatccccgcctttttttcctttttttttttttgaagattatttttactgctggaatacttttgtagaaaaccacgaaagaactttcaaagcctgggaagggctgcatgaaaattcagttcgtctctccagacagcttcggcgcatccttttggtaaggggcttcctcgctttttaaattttctttctttctctacagtcttttttggagtttcgtatatttcttatattttcttattgttcaatcactctcagttttcatctgatgaaaactttatttctcctccacatcagctttttcttctgctgtttcaccattcagagccctctgctaaggttccttttccctcccttttctttcttttgttgtttcacatctttaaatttctgtctctccccagggttgcgtttccttcctggtcagaattcttttctcctttttttttttttttttttttttttttaaacaaacaaacaaaaaacccaaaaaaactctttcccaatttactttcttccaacatgttacaaagccatccactcagtttagaagactctccggccccaccgacccccaacctcgttttgaagccattcactcaatttgcttctctctttctctacagcccctgtatgaggttgatgacttacgagacgcatttcgtactttgggactttgatagcaacttccaggaatgtcacacacgatgaaatatctctgctgaagacagtggataaaaaacagtccttcaagtcttctctgtttttattcttcaactctcactttcttagagtttacagaaaaaatatttatatacgactctttaaaaagatctatgtcttgaaaatagagaaggaacacaggtctggccagggacgtgctgcaattggtgcagttttgaatgcaacattgtcccctactgggaataacagaactgcaggacctgggagcatcctaaagtgtcaacgtttttctatgacttttaggtaggatgagagcagaaggtagatcctaaaaagcatggtgagaggatcaaatgtttttatatcaacatcctttattatttgattcatttgagttaacagtggtgttagtgatagatttttctattcttttcccttgacgtttactttcaagtaacacaaactcttccatcaggccatgatctataggacctcctaatgagagtatctgggtgattgtgaccccaaaccatctctccaaagcattaatatccaatcatgcgctgtatgttttaatcagcagaagcatgtttttatgtttgtacaaaagaagattgttatgggtggggatggaggtatagaccatgcatggtcaccttcaagctactttaataaaggatcttaaaatgggcaggaggactgtgaacaagacaccctaataatgggttgatgtctgaagtagcaaatcttctggaaacgcaaactcttttaaggaagtccctaatttagaaacacccacaaacttcacatatcataattagcaaacaattggaaggaagttgcttgaatgttggggagaggaaaatctattggctctcgtgggtctcttcatctcagaaatgccaatcaggtcaaggtttgctacattttgtatgtgtgtgatgcttctcccaaaggtatattaactatataagagagttgtgacaaaacagaatgataaagctgcgaaccgtggcacacgctcatagttctagctgcttgggaggttgaggagggaggatggcttgaacacaggtgttcaaggccagcctgggcaacataacaagatcctgtctctcaaaaaaaaaaaaaaaaaaaagaaagagagagggccgggcgtggtggctcacgcctgtaatcccagcactttgggaggccgagccgggcggatcacctgtggtcaggagtttgagaccagcctggccaacatggcaaaaccccgtctgtactcaaaatgcaaaaattagccaggcgtggtagcaggcacctgtaatcccagctacttgggaggctgaggcaggagaatcgcttgaacccaggaggtggaggttgcagtaagctgagatcgtgccgttgcactccagcctgggcgacaagagcaagactctgtctcagaaaaaaaaaaaaaaaagagagagagagagaaagagaacaatatttgggagagaaggatggggaagcattgcaaggaaattgtgctttatccaacaaaatgtaaggagccaataagggatccctatttgtctcttttggtgtctatttgtccctaacaactgtctttgacagtgagaaaaatattcagaataaccatatccctgtgccgttattacctagcaacccttgcaatgaagatgagcagatccacaggaaaacttgaatgcacaactgtcttattttaatcttattgtacataagtttgtaaaagagttaaaaattgttacttcatgtattcatttatattttatattattttgcgtctaatgattttttattaacatgatttccttttctgatatattgaaatggagtctcaaagcttcataaatttataactttagaaatgattctaataacaacgtatgtaattgtaacattgcagtaatggtgctacgaagccatttctcttgatttttagtaaacttttatgacagcaaatttgcttctggctcactttcaatcagttaaataaatgataaataattttggaagctgtgaagataaaataccaaataaaataatataaaagtgatttatatgaagttaaaataaaaaatcagtatgatggaataaacttg

SEQ ID NO: 262 - protein, 239 aa, Rattus norvegicus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLGL

SEQ ID NO: 263 - protein, 198 aa, Mus musculus [sequence omitted]

SEQ ID NO: 264 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 265 - protein, 430 aa, Rattus norvegicus
MGPFCLGCSHRKCYSPIRNLISQETFKFHFKNRLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 266 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 267 - protein, 384 aa, Pan sp.
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 268 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 269 - protein, 395 aa, Rattus norvegicus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFWRKKFQKGLCTLWRSGIHVDVMDLPQFADCWTNFVNPQRPFRPWNELEKNSWRIQRRLRRIKESWGL

SEQ ID NO: 270 - protein, 226 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAERFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 271 - protein, 490 aa, Pan sp.
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 272 - protein, 190 aa, Gorilla sp.
MNPQIRNPMKAMYPGTFYFQFKNLWEANDRNETWLCFTVEGIKRRSVVSWKTGVFRNQVDSETHCHAERCFLSWECDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 273 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 274 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 275 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 276 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 277 - protein, 224 aa, Rattus norvegicus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 278 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSFMIQVKILHTTKSPAV

SEQ ID NO: 279 - protein, 381 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKFNYDEFQHCWSKFVYSQRELFEPWNNLPKYYILLHFMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKKHVSLCIFTARIYRRQGRCQEGLRTLAEAGAKISFTYSEFKHCWDTFVDHQGCPFQPWDGLDEHSQDLSGRLRAILQNQEN

SEQ ID NO: 280 - protein, 182 aa, Homo sapiens
MDPPTFTFNFNNEPWWGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISFTYSEFKHCWDTFVDHQGCPFQPWDGLDEHSQDLSGRLRAILQ

SEQ ID NO: 281 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISFMTYSEFKHCWDTFVDHQGCPFQPWDGLDEHSQDLSGRLRAILQ

SEQ ID NO: 282 - protein, 218 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRGLPPCLNILRRKQPQLTFFTIALQSCHYQRLPPHILWATGLK

SEQ ID NO: 283 - protein, 218 aa, Artificial Sequence
  Description of Artificial Sequence: Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQHYQRLPPHILWATGLK

SEQ ID NO: 284 - protein, 8 aa, Artificial Sequence
  Description of Artificial Sequence: Synthetic peptide
SGGSSGGS

SEQ ID NO: 285 - protein, 4 aa, Artificial Sequence
  Description of Artificial Sequence: Synthetic peptide
GGGS

SEQ ID NO: 286 - protein, 5 aa, Artificial Sequence
  Description of Artificial Sequence: Synthetic peptide
GGGGS

SEQ ID NO: 287 - protein, 5 aa, Artificial Sequence
  Description of Artificial Sequence: Synthetic peptide
EAAAK

SEQ ID NO: 288 - protein, 21 aa, Artificial Sequence
  Description of Artificial Sequence: Synthetic peptide
  MISC_FEATURE (1)..(21): This sequence may encompass 1, 3 or 7 "Gly Gly Ser" repeating units
GGSGGSGGSGGSGGSGGSGGS

SEQ ID NO: 289 - protein, 5 aa, Artificial Sequence
  Description of Artificial Sequence: Synthetic peptide
PAPAP

SEQ ID NO: 290 - protein, 6 aa, Artificial Sequence
  Description of Artificial Sequence: Synthetic peptide
PAPAPA

SEQ ID NO: 291 - protein, 7 aa, Artificial Sequence
  Description of Artificial Sequence: Synthetic peptide
PAPAPAP

SEQ ID NO: 292 - protein, 8 aa, Artificial Sequence
  Description of Artificial Sequence: Synthetic peptide
PAPAPAPA

SEQ ID NO: 293 - protein, 9 aa, Artificial Sequence
  Description of Artificial Sequence: Synthetic peptide
PAPAPAPAP

SEQ ID NO: 294 - protein, 15 aa, Artificial Sequence
  Description of Artificial Sequence: Synthetic peptide
PAPAPAPAPAPAPAP

SEQ ID NO: 295 - protein, 21 aa, Artificial Sequence
  Description of Artificial Sequence: Synthetic peptide
PAPAPAPAPAPAPAPAPAPAP

SEQ ID NO: 296 - DNA, 22 bp, Unknown
  Description of Unknown: Target site sequence
gtattactattattatctgaga

SEQ ID NO: 297 - DNA, 22 bp, Unknown
  Description of Unknown: Target site sequence
gtgggactgatcccttaatgtg

SEQ ID NO: 298 - DNA, 21 bp, Unknown
  Description of Unknown: Target site sequence
gaaagagacagagaaggggca

SEQ ID NO: 299 - DNA, 22 bp, Unknown
  Description of Unknown: Target site sequence
gaaggctttactgtattacaga

SEQ ID NO: 300 - DNA, 21 bp, Unknown
  Description of Unknown: Target site sequence
gaccaaaacgagggacattta

SEQ ID NO: 301 - DNA, 21 bp, Unknown
  Description of Unknown: Target site sequence
gaccaggtcagcaaacatgtt

SEQ ID NO: 302 - DNA, 22 bp, Unknown
  Description of Unknown: Target site sequence
gactcagcgcccctgccgggcc

SEQ ID NO: 303 - DNA, 22 bp, Unknown
  Description of Unknown: Target site sequence
gagaagaaaccagggaacaggt

SEQ ID NO: 304 - DNA, 22 bp, Unknown
  Description of Unknown: Target site sequence
gagagagagcgggggcggtggg

SEQ ID NO: 305 - DNA, 22 bp, Unknown
  Description of Unknown: Target site sequence
gagtgggaactttctgatgcca

SEQ ID NO: 306 - DNA, 22 bp, Unknown
  Description of Unknown: Target site sequence
gatgtgtctactgttacttaca

SEQ ID NO: 307 - DNA, 22 bp, Unknown
  Description of Unknown: Target site sequence
gcacccaggggttctgcagagc

SEQ ID NO: 308 - DNA, 21 bp, Unknown
  Description of Unknown: Target site sequence
gcattccactccgtccgcctc

SEQ ID NO: 309 - DNA, 21 bp, Unknown
  Description of Unknown: Target site sequence
gccacagacttttccatttgc

SEQ ID NO: 310 - DNA, 21 bp, Unknown
  Description of Unknown: Target site sequence
gccacagtgggaggggacatg

SEQ ID NO: 311 - DNA, 21 bp, Unknown
  Description of Unknown: Target site sequence
gcccagcaattcactgtgaag

SEQ ID NO: 312 - DNA, 21 bp, Unknown
  Description of Unknown: Target site sequence
gcccagctccagcctctgatg

SEQ ID NO: 313 - DNA, 21 bp, Unknown
  Description of Unknown: Target site sequence
gccctgatctgcactgaacag

SEQ ID NO: 314 - DNA, 22 bp, Unknown
  Description of Unknown: Target site sequence
gcctcaagtctggttattttag

SEQ ID NO: 315 - DNA, 21 bp, Unknown
  Description of Unknown: Target site sequence
gcctggcagatgagaaccagg

SEQ ID NO: 316 - DNA, 22 bp, Unknown
  Description of Unknown: Target site sequence
gcgaaaggctcgcggcgaagga

SEQ ID NO: 317 - DNA, 22 bp, Unknown
  Description of Unknown: Target site sequence
gctcctctcacccttatgactc

SEQ ID NO: 318 - DNA, 21 bp, Unknown
  Description of Unknown: Target site sequence
gctgcaagggttggccaggct

SEQ ID NO: 319 - DNA, 21 bp, Unknown
  Description of Unknown: Target site sequence
ggagccagagaccagtgggca

SEQ ID NO: 320 - DNA, 22 bp, Unknown
  Description of Unknown: Target site sequence
ggcctccgtatcactctctgac

SEQ ID NO: 321 - DNA, 22 bp, Unknown
  Description of Unknown: Target site sequence
gggtacctgagtggggtgcatt

SEQ ID NO: 322 - DNA, 21 bp, Unknown
  Description of Unknown: Target site sequence
ggtcgacccttggtatccatg

SEQ ID NO: 323 - DNA, 21 bp, Unknown
  Description of Unknown: Target site sequence
ggtcgtagccagtccgaaccc

SEQ ID NO: 324 - DNA, 22 bp, Unknown
  Description of Unknown: Target site sequence
gtaactgaacccctgcaatcaa

SEQ ID NO: 325 - DNA, 22 bp, Unknown
  Description of Unknown: Target site sequence
gctttccttagctgtaaaagaa

SEQ ID NO: 326 - DNA, 90 bp, Artificial Sequence
  Description of Artificial Sequence: Synthetic oligonucleotide
ggtggtttgtgtattgggtgccttctatttccagctcgaagcgaaaaaacagataagttcataaccgcatgtaggaattttggtgggata

SEQ ID NO: 327 - DNA, 90 bp, Artificial Sequence
  Description of Artificial Sequence: Synthetic oligonucleotide
ggtggtttgtgtattgggtgtatcttaacaatgttaataacgtataaaggctgttcattccctcgcgcatgtaggaattttggtgggata

SEQ ID NO: 328 - DNA, 90 bp, Artificial Sequence
  Description of Artificial Sequence: Synthetic oligonucleotide
tggtttgtgtattgggtgaaggtgaaagggtgaaaaaaattgtctgtaagtaagggtggtaaagaataaatgtaggaattttggtgggat

SEQ ID NO: 329 - DNA, 60 bp, Artificial Sequence
  Description of Artificial Sequence: Synthetic primer
acactctttccctacacgacgctcttccgatctactgtcttttgatctacagcagttaat

SEQ ID NO: 330 - DNA, 53 bp, Artificial Sequence
  Description of Artificial Sequence: Synthetic primer
acactctttccctacacgacgctcttccgatctagcctctttcctgctagagc

SEQ ID NO: 331 - DNA, 53 bp, Artificial Sequence
  Description of Artificial Sequence: Synthetic primer
acactctttccctacacgacgctcttccgatctctttcgctgccctttcctct

SEQ ID NO: 332 - DNA, 59 bp, Artificial Sequence
  Description of Artificial Sequence: Synthetic primer
acactctttccctacacgacgctcttccgatctgatatctccaggctcctgtccattct

SEQ ID NO: 333 - DNA, 60 bp, Artificial Sequence
  Description of Artificial Sequence: Synthetic primer
acactctttccctacacgacgctcttccgatctccatcctaagtgaagcagcatatttga

SEQ ID NO: 334 - DNA, 58 bp, Artificial Sequence
  Description of Artificial Sequence: Synthetic primer
acactctttccctacacgacgctcttccgatctaggtgggggtgactccttttttgga

SEQ ID NO: 335 - DNA, 59 bp, Artificial Sequence
  Description of Artificial Sequence: Synthetic primer
acactctttccctacacgacgctcttccgatctcttgtctgtccaaggagaatgaggtc

SEQ ID NO: 336 - DNA, 56 bp, Artificial Sequence
  Description of Artificial Sequence: Synthetic primer
acactctttccctacacgacgctcttccgatctgacctggaggcctgggatccaca

SEQ ID NO: 337 - DNA, 60 bp, Artificial Sequence
  Description of Artificial Sequence: Synthetic primer
acactctttccctacacgacgctcttccgatctcctttaggacacatgctgtctaccaca

SEQ ID NO: 338 - DNA, 60 bp, Artificial Sequence
  Description of Artificial Sequence: Synthetic primer
acactctttccctacacgacgctcttccgatctgccaaagtctgaggtttagttgactaa

SEQ ID NO: 339 - DNA, 56 bp, Artificial Sequence
  Description of Artificial Sequence: Synthetic primer
acactctttccctacacgacgctcttccgatctgtgggaacatcaccggagcctgg

SEQ ID NO: 340 - DNA, 60 bp, Artificial Sequence
  Description of Artificial Sequence: Synthetic primer
acactctttccctacacgacgctcttccgatctctgacactaaatatgtggttttttgct

SEQ ID NO: 341 - DNA, 58 bp, Artificial Sequence
  Description of Artificial Sequence: Synthetic primer
acactctttccctacacgacgctcttccgatctcgaactcctaggctcaagtaatcca

SEQ ID NO: 342 - DNA, 60 bp, Artificial Sequence
  Description of Artificial Sequence: Synthetic primer
acactctttccctacacgacgctcttccgatctgccagtaattgcattaaaccctcacta

SEQ ID NO: 343 - DNA, 60 bp, Artificial Sequence
  Description of Artificial Sequence: Synthetic primer
acactctttccctacacgacgctcttccgatctggctcccactctctcccagtgtcctca

SEQ ID NO: 344 - DNA, 53 bp, Artificial Sequence
  Description of Artificial Sequence: Synthetic primer
acactctttccctacacgacgctcttccgatcttctgcctgtgtgaagctccc

SEQ ID NO: 345 - DNA, 56 bp, Artificial Sequence
  Description of Artificial Sequence: Synthetic primer
acactctttccctacacgacgctcttccgatctgggagtcctcccttcacccctgc

SEQ ID NO: 346 - DNA, 59 bp, Artificial Sequence
  Description of Artificial Sequence: Synthetic primer
acactctttccctacacgacgctcttccgatctgtgccaaggcataaaagccttccctg

SEQ ID NO: 347 - DNA, 58 bp, Artificial Sequence
  Description of Artificial Sequence: Synthetic primer
acactctttccctacacgacgctcttccgatctactcgctggcctggcctttcttctc

SEQ ID NO: 348 - DNA, 60 bp, Artificial Sequence
  Description of Artificial Sequence: Synthetic primer
acactctttccctacacgacgctcttccgatctaagcgggttctcattgttcccgtgtct

SEQ ID NO: 349 - DNA, 60 bp, Artificial Sequence
  Description of Artificial Sequence: Synthetic primer
acactctttccctacacgacgctcttccgatctaaccagtccctgtcctgaatctatcta

SEQ ID NO: 350 - DNA, 60 bp, Artificial Sequence
  Description of Artificial Sequence: Synthetic primer
acactctttccctacacgacgctcttccgatctttgctttcgggtatctactaggagtca

SEQ ID NO: 351 - DNA, 56 bp, Artificial Sequence
  Description of Artificial Sequence: Synthetic primer
acactctttccctacacgacgctcttccgatctggggctgggcttgcgttgccgct

SEQ ID NO: 352 - DNA, 57 bp, Artificial Sequence
  Description of Artificial Sequence: Synthetic primer
acactctttccctacacgacgctcttccgatctgggctatcaaacctcatgattggc

SEQ ID NO: 353 - DNA, 59 bp, Artificial Sequence
  Description of Artificial Sequence: Synthetic primer
acactctttccctacacgacgctcttccgatctaagctgtccagctggaagcctggtaa

SEQ ID NO: 354 - DNA, 60 bp, Artificial Sequence
  Description of Artificial Sequence: Synthetic primer
acactctttccctacacgacgctcttccgatctgcctaagttatatgcaaacatcatgcc

SEQ ID NO: 355 - DNA, 53 bp, Artificial Sequence
  Description of Artificial Sequence: Synthetic primer
acactctttccctacacgacgctcttccgatctgctgctggaataccgaggac

SEQ ID NO: 356 - DNA, 60 bp, Artificial Sequence
  Description of Artificial Sequence: Synthetic primer
acactctttccctacacgacgctcttccgatctacgaggtaagtgtgtggattagtttca

SEQ ID NO: 357 - DNA, 53 bp, Artificial Sequence
  Description of Artificial Sequence: Synthetic primer
acactctttccctacacgacgctcttccgatctagtggttactttgccgggtt

SEQ ID NO: 358 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngaacccaggtagccagagac

SEQ ID NO: 359 - DNA, 57 bp, Artificial Sequence
  Description of Artificial Sequence: Synthetic primer
  modified_base (34)..(37): a, c, t, g, unknown or other
acactctttccctacacgacgctcttccgatctnnnncattgcagagaggcgtatca

SEQ ID NO: 360 - DNA, 56 bp, Artificial Sequence
  Description of Artificial Sequence: Synthetic primer
  modified_base (34)..(37): a, c, t, g, unknown or other
acactctttccctacacgacgctcttccgatctnnnncagagtgctgcttgctgct

SEQ ID NO: 361 - DNA, 53 bp, Artificial Sequence
  Description of Artificial Sequence: Synthetic primer
acactctttccctacacgacgctcttccgatcttttagtgactagccgccacc

SEQ ID NO: 362 - DNA, 58 bp, Artificial Sequence
  Description of Artificial Sequence: Synthetic primer
  modified_base (34)..(37): a, c, t, g, unknown or other
acactctttccctacacgacgctcttccgatctnnnngaaaccatgtctctggatgcc

SEQ ID NO: 363 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnaggccttttcttggggatgc

SEQ ID NO: 364 - DNA, 56 bp, Artificial Sequence
  Description of Artificial Sequence: Synthetic primer
tggagttcagacgtgtgctcttccgatctaagaaacagattacagaagtagatgca

SEQ ID NO: 365 - DNA, 49 bp, Artificial Sequence
  Description of Artificial Sequence: Synthetic primer
tggagttcagacgtgtgctcttccgatcttctctcctatgtgctggcct

SEQ ID NO: 366 - DNA, 49 bp, Artificial Sequence
  Description of Artificial Sequence: Synthetic primer
tggagttcagacgtgtgctcttccgatctctacactggaaccccgactc

SEQ ID NO: 367 - DNA, 56 bp, Artificial Sequence
  Description of Artificial Sequence: Synthetic primer
tggagttcagacgtgtgctcttccgatctccagccgatatttcagaactaatcaga

SEQ ID NO: 368 - DNA, 52 bp, Artificial Sequence
  Description of Artificial Sequence: Synthetic primer
tggagttcagacgtgtgctcttccgatctaacaatggcaagggcctgccctg

SEQ ID NO: 369 - DNA, 56 bp, Artificial Sequence
  Description of Artificial Sequence: Synthetic primer
tggagttcagacgtgtgctcttccgatctgggcagaaggaaaaatctatcctggaa

SEQ ID NO: 370 - DNA, 56 bp, Artificial Sequence
  Description of Artificial Sequence: Synthetic primer
tggagttcagacgtgtgctcttccgatctgcacagaacccgctgctagagactcca

SEQ ID NO: 371 - DNA, 56 bp, Artificial Sequence
  Description of Artificial Sequence: Synthetic primer
tggagttcagacgtgtgctcttccgatctggaaagtctggttagagctcagaggga

SEQ ID NO: 372 - DNA, 54 bp, Artificial Sequence
  Description of Artificial Sequence: Synthetic primer
tggagttcagacgtgtgctcttccgatctgtggtggagtgctctgtgtttgtct

SEQ ID NO: 373 - DNA, 54 bp, Artificial Sequence
  Description of Artificial Sequence: Synthetic primer
tggagttcagacgtgtgctcttccgatctattacaggtgtgggccaccttgccc

SEQ ID NO: 374 - DNA, 56 bp, Artificial Sequence
  Description of Artificial Sequence: Synthetic primer
tggagttcagacgtgtgctcttccgatcttgcataacctacacacatcctctgata

SEQ ID NO: 375 - DNA, 56 bp, Artificial Sequence
  Description of Artificial Sequence: Synthetic primer
tggagttcagacgtgtgctcttccgatctggattgcggaaatccccaacttatagc

SEQ ID NO: 376 - DNA, 52 bp, Artificial Sequence
  Description of Artificial Sequence: Synthetic primer
tggagttcagacgtgtgctcttccgatctgcctggactccagacaggcttcc

SEQ ID NO: 377 - DNA, 56 bp, Artificial Sequence
  Description of Artificial Sequence: Synthetic primer
tggagttcagacgtgtgctcttccgatctaaggccaagaatcttgctagtagtgga

SEQ ID NO: 378 - DNA, 56 bp, Artificial Sequence
  Description of Artificial Sequence: Synthetic primer
tggagttcagacgtgtgctcttccgatctggatagagcaaaagaagtagtgcctgg

SEQ ID NO: 379 - DNA, 54 bp, Artificial Sequence
  Description of Artificial Sequence: Synthetic primer
tggagttcagacgtgtgctcttccgatcttgaaactgtcactgaaacatctggt

SEQ ID NO: 380 - DNA, 55 bp, Artificial Sequence
  Description of Artificial Sequence: Synthetic primer
tggagttcagacgtgtgctcttccgatctgttctcaagaaaaggccacccctcag

SEQ ID NO: 381 - DNA, 56 bp, Artificial Sequence
  Description of Artificial Sequence: Synthetic primer
tggagttcagacgtgtgctcttccgatcttgcttagagggtaaaaacccaggagga

SEQ ID NO: 382 - DNA, 52 bp, Artificial Sequence
  Description of Artificial Sequence: Synthetic primer
tggagttcagacgtgtgctcttccgatctgggagagaggcagggcgggcatg

SEQ ID NO: 383 - DNA, 56 bp, Artificial Sequence
  Description of Artificial Sequence: Synthetic primer
tggagttcagacgtgtgctcttccgatcttccgcctccggagtagggctgcagaga

SEQ ID NO: 384 - DNA, 55 bp, Artificial Sequence
  Description of Artificial Sequence: Synthetic primer
tggagttcagacgtgtgctcttccgatctggaaggcagactgtatctggtctttt

SEQ ID NO: 385 - DNA, 55 bp, Artificial Sequence
  Description of Artificial Sequence: Synthetic primer
tggagttcagacgtgtgctcttccgatcttctagcaggaaagaggctcaggccca

SEQ ID NO: 386 - DNA, 54 bp, Artificial Sequence
  Description of Artificial Sequence: Synthetic primer
tggagttcagacgtgtgctcttccgatctagaccgagtggcagtgacagcaagc

SEQ ID NO: 387 - DNA, 55 bp, Artificial Sequence
  Description of Artificial Sequence: Synthetic primer
tggagttcagacgtgtgctcttccgatctacacacagacactgcagagaataaca

SEQ ID NO: 388 - DNA, 52 bp, Artificial Sequence
  Description of Artificial Sequence: Synthetic primer
tggagttcagacgtgtgctcttccgatctccgcccagcactcgcagagcaga

SEQ ID NO: 389 - DNA, 56 bp, Artificial Sequence
  Description of Artificial Sequence: Synthetic primer
tggagttcagacgtgtgctcttccgatctgatgagaatgcaccatgattccaatca

SEQ ID NO: 390 - DNA, 50 bp, Artificial Sequence
  Description of Artificial Sequence: Synthetic primer
tggagttcagacgtgtgctcttccgatctgcaactctcttttctccggga

SEQ ID NO: 391 - DNA, 56 bp, Artificial Sequence
  Description of Artificial Sequence: Synthetic primer
tggagttcagacgtgtgctcttccgatctctaccaaggagagtcattcctttcaga

SEQ ID NO: 392 - DNA, 49 bp, Artificial Sequence
  Description of Artificial Sequence: Synthetic primer
tggagttcagacgtgtgctcttccgatctaagacagtctgggaagcgtg

SEQ ID NO: 393 - DNA, 49 bp, Artificial Sequence
  Description of Artificial Sequence: Synthetic primer
tggagttcagacgtgtgctcttccgatcttcctttcaacccgaacggag

SEQ ID NO: 394 - DNA, 47 bp, Artificial Sequence
  Description of Artificial Sequence: Synthetic primer
tggagttcagacgtgtgctcttccgatctggggtcccaggtgctgac

SEQ ID NO: 395 - DNA, 54 bp, Artificial Sequence
  Description of Artificial Sequence: Synthetic primer
tggagttcagacgtgtgctcttccgatctaaaagggagattggagacacggaga

SEQ ID NO: 396 - DNA, 49 bp, Artificial Sequence
  Description of Artificial Sequence: Synthetic primer
tggagttcagacgtgtgctcttccgatcttgcgctttacaggtctccag

SEQ ID NO: 397 - DNA, 52 bp, Artificial Sequence
  Description of Artificial Sequence: Synthetic primer
tggagttcagacgtgtgctcttccgatctagagaaatcacactagctagcct

SEQ ID NO: 398 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnggtggtttgtgtattgggtg

SEQ ID NO: 399 - DNA, 51 bp, Artificial Sequence
  Description of Artificial Sequence: Synthetic primer
tggagttcagacgtgtgctcttccgatcttatcccaccaaaattcctacat

SEQ ID NO: 400 - RNA, 76 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugc

SEQ ID NO: 401 - RNA, 84 nt, Artificial Sequence
  Description of Artificial Sequence: Synthetic oligonucleotide
guuuuaguacucuguaaugaaaauuacagaaucuacuaaaacaaggcaaaaugccguguuuaucucgucaacuuguuggcgaga

SEQ ID NO: 402 - RNA, 22 nt, Artificial Sequence
  Description of Artificial Sequence: Synthetic oligonucleotide
gaugugucuacuguuacuuaca

SEQ ID NO: 403 - RNA, 22 nt, Artificial Sequence
  Description of Artificial Sequence: Synthetic oligonucleotide
gcacccagggguucugcagagc

SEQ ID NO: 404 - RNA, 21 nt, Artificial Sequence
  Description of Artificial Sequence: Synthetic oligonucleotide
gcauuccacuccguccgccuc

SEQ ID NO: 405 - RNA, 21 nt, Artificial Sequence
  Description of Artificial Sequence: Synthetic oligonucleotide
gccacagacuuuuccauuugc

SEQ ID NO: 406 - RNA, 21 nt, Artificial Sequence
  Description of Artificial Sequence: Synthetic oligonucleotide
gccacagugggaggggacaug

SEQ ID NO: 407 - RNA, 21 nt, Artificial Sequence
  Description of Artificial Sequence: Synthetic oligonucleotide
gcccagcaauucacugugaag

SEQ ID NO: 408 - RNA, 21 nt, Artificial Sequence
  Description of Artificial Sequence: Synthetic oligonucleotide
gcccagcuccagccucugaug

SEQ ID NO: 409 - RNA, 21 nt, Artificial Sequence
  Description of Artificial Sequence: Synthetic oligonucleotide
gcccugaucugcacugaacag

SEQ ID NO: 410 - RNA, 22 nt, Artificial Sequence
  Description of Artificial Sequence: Synthetic oligonucleotide
gccucaagucugguuauuuuag

SEQ ID NO: 411 - RNA, 21 nt, Artificial Sequence
  Description of Artificial Sequence: Synthetic oligonucleotide
gccuggcagaugagaaccagg

SEQ ID NO: 412 - RNA, 22 nt, Artificial Sequence
  Description of Artificial Sequence: Synthetic oligonucleotide
guauuacuauuauuaucugaga

SEQ ID NO: 413 - RNA, 22 nt, Artificial Sequence
  Description of Artificial Sequence: Synthetic oligonucleotide
gugggacugaucccuuaaugug

SEQ ID NO: 414 - RNA, 21 nt, Artificial Sequence
  Description of Artificial Sequence: Synthetic oligonucleotide
gaaagagacagagaaggggca

SEQ ID NO: 415 - RNA, 22 nt, Artificial Sequence
  Description of Artificial Sequence: Synthetic oligonucleotide
gaaggcuuuacuguauuacaga

SEQ ID NO: 416 - RNA, 21 nt, Artificial Sequence
  Description of Artificial Sequence: Synthetic oligonucleotide
gaccaaaacgagggacauuua

SEQ ID NO: 417 - RNA, 21 nt, Artificial Sequence
  Description of Artificial Sequence: Synthetic oligonucleotide
gaccaggucagcaaacauguu

SEQ ID NO: 418 - RNA, 22 nt, Artificial Sequence
  Description of Artificial Sequence: Synthetic oligonucleotide
gacucagcgccccugccgggcc

SEQ ID NO: 419 - RNA, 22 nt, Artificial Sequence
  Description of Artificial Sequence: Synthetic oligonucleotide
gagaagaaaccagggaacaggu

SEQ ID NO: 420 - RNA, 22 nt, Artificial Sequence
  Description of Artificial Sequence: Synthetic oligonucleotide
gagugggaacuuucugaugcca

SEQ ID NO: 421 - RNA, 22 nt, Artificial Sequence
  Description of Artificial Sequence: Synthetic oligonucleotide
gcgaaaggcucgcggcgaagga

SEQ ID NO: 422 - RNA, 22 nt, Artificial Sequence
  Description of Artificial Sequence: Synthetic oligonucleotide
gcuccucucacccuuaugacuc

SEQ ID NO: 423 - RNA, 21 nt, Artificial Sequence
  Description of Artificial Sequence: Synthetic oligonucleotide
gcugcaaggguuggccaggcu

SEQ ID NO: 424 - RNA, 21 nt, Artificial Sequence
  Description of Artificial Sequence: Synthetic oligonucleotide
ggagccagagaccagugggca

SEQ ID NO: 425 - RNA, 22 nt, Artificial Sequence
  Description of Artificial Sequence: Synthetic oligonucleotide
ggccuccguaucacucucugac

SEQ ID NO: 426 - RNA, 22 nt, Artificial Sequence
  Description of Artificial Sequence: Synthetic oligonucleotide
ggguaccugaguggggugcauu

SEQ ID NO: 427 - RNA, 21 nt, Artificial Sequence
  Description of Artificial Sequence: Synthetic oligonucleotide
ggucgacccuugguauccaug

SEQ ID NO: 428 - RNA, 21 nt, Artificial Sequence
  Description of Artificial Sequence: Synthetic oligonucleotide
ggucguagccaguccgaaccc

SEQ ID NO: 429 - RNA, 22 nt, Artificial Sequence
  Description of Artificial Sequence: Synthetic oligonucleotide
guaacugaaccccugcaaucaa

SEQ ID NO: 430 - RNA, 20 nt, Artificial Sequence
  Description of Artificial Sequence: Synthetic oligonucleotide
guggcacugcggcuggaggu

SEQ ID NO: 431 - RNA, 21 nt, Artificial Sequence
  Description of Artificial Sequence: Synthetic oligonucleotide
guagggccuucgcgcaccuca

SEQ ID NO: 432 - RNA, 21 nt, Artificial Sequence
  Description of Artificial Sequence: Synthetic oligonucleotide
ggccuccccaaagccuggcca

SEQ ID NO: 433 - RNA, 22 nt, Artificial Sequence
  Description of Artificial Sequence: Synthetic oligonucleotide
gagucccaagaugugcccuggg

SEQ ID NO: 434 - RNA, 21 nt, Artificial Sequence
  Description of Artificial Sequence: Synthetic oligonucleotide
gcacauucacggucucagugc

SEQ ID NO: 435 - RNA, 22 nt, Artificial Sequence
  Description of Artificial Sequence: Synthetic oligonucleotide
ggaaaccuugaauaagaaugga

SEQ ID NO: 436 - DNA, 8956 bp, Artificial Sequence
  Description of Artificial Sequence: Synthetic polynucleotide
tgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgagcagcgagacaggccctgtggccgtggaccccaccctgcggcggagaatcgagcctcatgagttcgaggtgttcttcgaccctcgggaactgagaaaagagacatgcctgctgtacgagatcaactggggcggaagacacagcatctggcggcacaccagccagaacaccaacaagcacgtggaagtgaatttcatcgagaagttcaccaccgaaagatacttctgccccaacaccagatgcagcatcacatggttcctgtcttggtccccttgcggcgagtgctctagagccatcaccgagttcctgagcagatatcctcacgtgacactgttcatctacatcgccagactgtatcaccacgccgatcctagaaatagacagggcctgcgggacctgatcagctccggcgtgaccatccagatcatgaccgagcaggagagcggctactgttggagaaacttcgtgaactactctcctagcaacgaggcccactggcctagatacccccacctgtgggtgcggctgtacgtgctggaactgtactgcatcatcctgggactgcctccatgtctgaacatcctgagaagaaagcagcctcagctgaccttcttcacaatcgccctgcagagctgccactaccagagactgcccccccacatcctgtgggccaccggcctgaagcttaagagcggaggatctcttaagagcggaggatctagcggcggctctagcggatctgagacacctggcacaagcgagtctgccacacctgagagtagcggcggatcttctggtggctctgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggtggaagcggaggatctggcggcagcaccaatctgagcgacatcatcgagaaagagacaggcaagcagctggtcatccaagagtccatcctgatgctgcctgaagaggtggaagaagtgatcggcaacaagcccgagtccgacatcctggtgcacaccgcctacgatgagagcaccgacgagaacgtgatgctgctgacctctgacgcccctgagtacaagccttgggctctcgtgatccaggacagcaacggcgagaacaagatcaagatgctgagcggcggctctggtggctctggcggatctacaaacctgtccgatattattgagaaagaaaccgggaaacagctcgtgattcaagagtctattctcatgctcccggaagaagtcgaggaagtcattggaaacaagcctgagagcgatattctggtccatacagcctacgacgagtctaccgatgagaatgtcatgctcctcaccagcgacgctcccgagtataagccatgggcacttgtcattcaggactccaatggggaaaacaaaatcaaaatgctcccaaagaaaaaacgcaaggtggagggagctgataagcgcaccgccgatggttccgagttcgaaagccccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcttactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgc

SEQ ID NO: 437 - DNA, 708 bp, Artificial Sequence
  Description of Artificial Sequence: Synthetic polynucleotide
atgacctctgagaagggccctagcacaggcgaccccaccctgcggcggagaatcgagagctgggagttcgacgtgttctacgaccctagagaactgagaaaggaaacctgcctgctgtacgagatcaagtggggcatgagcagaaagatctggcggagctctggcaagaacaccaccaaccacgtggaagtgaatttcatcaagaagttcaccagcgagagaaggttccacagcagcatcagctgcagcatcacctggttcctgagctggtccccttgctgggaatgcagccaggccatcagagagttcctgagccaacaccccggagtgacactggtgatctacgtggccagactgttctggcacatggaccagagaaacagacagggcctgagagatctggtcaacagcggcgtgactatccagatcatgcgggccagcgagtactaccactgttggcggaacttcgtgaactacccccccggcgatgaggcccactggcctcagtaccctcctctgtggatgatgctgtacgccctggaactgcactgcatcatcctgtctctgcctccatgtctgaagatctctagaagatggcagaaccacctggccttcttcagactgcacctgcagaattgccactaccagaccatccccccccacatcctgctggctacaggcctgatccacccttctgtgacctggaga

SEQ ID NO: 438 - DNA, 582 bp, Artificial Sequence
  Description of Artificial Sequence: Synthetic polynucleotide
atgaagccccagatcagggaccaccgccccaatcctatggaggccatgtaccctcacatcttctattttcacttcgagaacctggagaaggcctacggccggaatgagacctggctgtgctttacagtggagatcatcaagcagtatctgccagtgccctggaagaagggcgtgttccggaaccaggtggatccagagacccactgccacgccgagaagtgttttctgtcctggttctgtaacaatacactgtctcccaagaagaattaccaggtgacctggtatacaagctggtccccttgcccagagtgtgcaggagaggtggcagagtttctggcagagcacagcaacgtgaagctgaccatctacacagcccggctgtactatttctgggacaccgattatcaggagggcctgagatctctgagcgaggagggcgcctccgtggagatcatggactacgaggattttcagtattgctgggagaacttcgtgtacgacgatggcgagccttttaagaggtggaagggcctgaagtataatttccagtctctgacacggagactgcgcgagatcctgcag

SEQ ID NO: 439 - DNA, 576 bp, Artificial Sequence
  Description of Artificial Sequence: Synthetic polynucleotide
atggccgacagctccgagaagatgaggggccagtacatcagccgcgacacctttgagaagaattataagcccatcgatggcacaaaggaggcccacctgctgtgcgagatcaagtggggcaagtacggcaagccttggctgcactggtgtcagaatcagcggatgaacatccacgccgaggactatttcatgaacaatatctttaaggccaagaagcaccctgtgcactgctacgtgacctggtatctgtcttggagcccatgcgccgattgtgcctccaagatcgtgaagttcctggaggagcggccctacctgaagctgaccatctatgtggcccagctgtactatcacacagaggaggagaataggaagggcctgcggctgctgcggagcaagaaagtgatcatccgcgtgatggacatctccgattacaactattgctggaaggtgttcgtgtctaaccagaatggcaacgaggactactggccactgcagtttgatccctgggtgaaggagaattattctcggctgctggatatcttctgggagtccaagtgtagatctcccaacccttgg

SEQ ID NO: 440 - DNA, 840 bp, Artificial Sequence
  Description of Artificial Sequence: Synthetic polynucleotide
atggacccacagaggctgcgccagtggcccggccctggcccagcaagcaggggcggctacggccagcggccaagaatcaggaaccccgaggagtggtttcacgagctgtctccccggaccttcagctttcacttccgcaacctgaggttcgcatccggccgcaatcggtcttatatctgctgtcaggtggagggcaagaactgcttctttcagggcatctttcagaatcaggtgccacctgacccaccatgccacgcagagctgtgcttcctgtcttggttccagagctggggcctgtcccccgatgagcactactatgtgacatggtttatctcttggagcccttgctgtgagtgtgccgccaaggtggcccagttcctggaggagaaccgcaacgtgagcctgtctctgagcgccgcaaggctgtactatttctggaagtccgagtctagagagggactgcggagactgagcgacctgggagcacaagtgggaatcatgtcctttcaggatttccagcactgctggaacaattttgtgcacaacctgggcatgcccttccagccttggaagaagctgcacaagaattaccagaggctggtgaccgagctgaagcagatcctgcgcgaggagcctgccacatatggctctccacaggcccagggcaaggtgagaatcggaagcaccgcagcaggactgaggcacagccactcccacacacgctccgaggcacacctgaggcctaaccacagctccagacagcacaggatcctgaatcctccacgggaggccagagccaggacctgcgtgctggtggatgcctcttggatctgttacaga

SEQ ID NO: 441 - DNA, 933 bp, Artificial Sequence
  Description of Artificial Sequence: Synthetic polynucleotide
ccggaattgccagctggggcgccctctggtaaggttgggaagccctgcaaagtaaactggatggctttcttgccgccaaggatctgatggcgcaggggatcaagatctgatcaagagacaggatgaggatcctttcgcatgatcgaataagatggattgcacgcaggttctccggccgcttaggtggagcgcctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcattaactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaa

SEQ ID NO: 442 - protein, 36 aa, Artificial Sequence
  Description of Artificial Sequence: Synthetic polypeptide
  MOD_RES (6)..(6): Ile, Ala, Val, Ser, Thr or Phe
TLFIFXARLYHHEDPRNRQGLRDLISAGVTIQIMTE

SEQ ID NO: 443 - protein, 36 aa, Artificial Sequence
  Description of Artificial Sequence: Synthetic polypeptide
TLFIYIARLYHHTDQRNRQGLRDLISSGVTIQIMTE

SEQ ID NO: 444 - protein, 36 aa, Artificial Sequence
  Description of Artificial Sequence: Synthetic polypeptide
TLFIYAARLYHHTDQRNRQGLRDLISRGVTIRIMTE

SEQ ID NO: 445 - protein, 36 aa, Artificial Sequence
  Description of Artificial Sequence: Synthetic polypeptide
TLVIYVARLFWHMDQQNRQGLRDLVNSGVTIQIMRA

SEQ ID NO: 446 - protein, 36 aa, Artificial Sequence
  Description of Artificial Sequence: Synthetic polypeptide
TLVIYVARLFWHMDQRNRQGLRDLVNSGVTIQIMRA

SEQ ID NO: 447 - protein, 36 aa, Artificial Sequence
  Description of Artificial Sequence: Synthetic polypeptide
TLIIFVARLFQHMDRRNRQGLKDLVTSGVTVRVMSV

SEQ ID NO: 448 - protein, 36 aa, Artificial Sequence
  Description of Artificial Sequence: Synthetic polypeptide
TLAIFISRLYWHMDQQHRQGLKELVHSGVTIQIMSY

SEQ ID NO: 449 - protein, 36 aa, Artificial Sequence
  Description of Artificial Sequence: Synthetic polypeptide
RLLILVSRLFMWEEPEVQAALKKLKEAGCKLRIMKP

SEQ ID NO: 450 - protein, 36 aa, Artificial Sequence
  Description of Artificial Sequence: Synthetic polypeptide
RLLILVGRLFMWEEPEIQAALKKLKEAGCKLRIMKP

SEQ ID NO: 451 - protein, 36 aa, Artificial Sequence
  Description of Artificial Sequence: Synthetic polypeptide
RLLILVGRLFMWEELEIQDALKKLKEAGCKLRIMKP

SEQ ID NO: 452 - protein, 36 aa, Artificial Sequence
  Description of Artificial Sequence: Synthetic polypeptide
RLLILVGRLFMWEEPEIQAALRKLKEAGCRLRIMKP

SEQ ID NO: 453 - protein, 36 aa, Artificial Sequence
  Description of Artificial Sequence: Synthetic polypeptide
SLDIFSSRLYNVQDPETQQNLCRLVQEGAQVAAMDL

SEQ ID NO: 454 - protein, 35 aa, Artificial Sequence
  Description of Artificial Sequence: Synthetic polypeptide
RLRIFAARIYDYDPLYKEALQMLRDAGAQVSIMTY

SEQ ID NO: 455 - protein, 36 aa, Artificial Sequence
  Description of Artificial Sequence: Synthetic polypeptide
NLTIFTARLYYFQYPCYQEGLRSLSQEGVAVEIMDY

SEQ ID NO: 456 - protein, 36 aa, Artificial Sequence
  Description of Artificial Sequence: Synthetic polypeptide
NLTIFTARLCYFWDTDYQEGLCSLSQEGASVKIMGY

SEQ ID NO: 457 - protein, 36 aa, Artificial Sequence
  Description of Artificial Sequence: Synthetic polypeptide
NLTIFTARLYYFWDTDYQEGLRSLSQEGASVEIMGY

SEQ ID NO: 458 - protein, 35 aa, Artificial Sequence
  Description of Artificial Sequence: Synthetic polypeptide
SLCIFTARIYDDQGRCQEGLRTLAEAGAKISIMTY

SEQ ID NO: 459 - protein, 37 aa, Artificial Sequence
  Description of Artificial Sequence: Synthetic polypeptide
SLRIFTARLYFCEDRKAEPEGLRRLHRAGVQIAIMTF

SEQ ID NO: 460 - protein, 37 aa, Artificial Sequence
  Description of Artificial Sequence: Synthetic polypeptide
SLRIFAARLYFCEDRKAEPEGLRRLHRAGVQIAIMTF

SEQ ID NO: 461 - protein, 38 aa, Artificial Sequence
  Description of Artificial Sequence: Synthetic polypeptide
SLRIFTARLYFCDKERKAEPEGLRRLHRAGVQIAIMTF

SEQ ID NO: 462 - protein, 38 aa, Artificial Sequence
  Description of Artificial Sequence: Synthetic polypeptide
TLTMHFSRIYDRDREGDHRGLRGLKHVSNSFRMGVVGR

SEQ ID NO: 463 - protein, 36 aa, Artificial Sequence
  Description of Artificial Sequence: Synthetic polypeptide
TLFIYIARLYHHADPRNRQGLRDLISSGVTIQIMTE

SEQ ID NO: 464 - protein, 36 aa, Artificial Sequence
  Description of Artificial Sequence: Synthetic polypeptide
TLFIYIARLYHHADPENRQGLRDLISSGVTIQIMTE

SEQ ID NO: 465 - protein, 36 aa, Artificial Sequence
  Description of Artificial Sequence: Synthetic polypeptide
TLFIYIARLYHHADPENRQGLEDLISSGVTIQIMTE

SEQ ID NO: 466 - protein, 15 aa, Artificial Sequence
  Description of Artificial Sequence: Synthetic peptide
ELRKETCLLYEINWG

SEQ ID NO: 467 - protein, 11 aa, Artificial Sequence
  Description of Artificial Sequence: Synthetic peptide
IWRHTSQNTNK

SEQ ID NO: 468 - protein, 12 aa, Artificial Sequence
  Description of Artificial Sequence: Synthetic peptide
CSITWFLSWSPC

SEQ ID NO: 469 - protein, 18 aa, Artificial Sequence
  Description of Artificial Sequence: Synthetic peptide
RYPHVTLFIYIARLYHHA

SEQ ID NO: 470 - protein, 14 aa, Artificial Sequence
  Description of Artificial Sequence: Synthetic peptide
ELRKETCLLYEIKW

SEQ ID NO: 471 - protein, 11 aa, Artificial Sequence
  Description of Artificial Sequence: Synthetic peptide
IWRHSNQNTSQ

SEQ ID NO: 472 - protein, 18 aa, Artificial Sequence
  Description of Artificial Sequence: Synthetic peptide
HYPNVTLAIFISRLYWHM

SEQ ID NO: 473 - protein, 14 aa, Artificial Sequence
  Description of Artificial Sequence: Synthetic peptide
ELRKETCLLYEIRW

SEQ ID NO: 474 - protein, 11 aa, Artificial Sequence
  Description of Artificial Sequence: Synthetic peptide
IWRHTGQNTSR

SEQ ID NO: 475 - protein, 12 aa, Artificial Sequence
  Description of Artificial Sequence: Synthetic peptide
CSIVWFLSWSPC

SEQ ID NO: 476 - protein, 18 aa, Artificial Sequence
  Description of Artificial Sequence: Synthetic peptide
GHPNVTLFIYAARLYHHT

SEQ ID NO: 477 - protein, 14 aa, Artificial Sequence
  Description of Artificial Sequence: Synthetic peptide
ELRKETCLLYEINW

SEQ ID NO: 478 - protein, 11 aa, Artificial Sequence
  Description of Artificial Sequence: Synthetic peptide
VWRHTSQNTSN

SEQ ID NO: 479 - protein, 18 aa, Artificial Sequence
  Description of Artificial Sequence: Synthetic peptide
RHPYVTLFIYIARLYHHT

SEQ ID NO: 480 - protein, 14 aa, Artificial Sequence
  Description of Artificial Sequence: Synthetic peptide
ELRKEACLLYEIKW

SEQ ID NO: 481 - protein, 11 aa, Artificial Sequence
  Description of Artificial Sequence: Synthetic peptide
TWRSSGKNTTN

SEQ ID NO: 482 - protein, 18 aa, Artificial Sequence
  Description of Artificial Sequence: Synthetic peptide
QHPGVTLIIFVARLFQHM

SEQ ID NO: 483 - protein, 11 aa, Artificial Sequence
  Description of Artificial Sequence: Synthetic peptide
IWRSSGKNTTN

SEQ ID NO: 484 - protein, 18 aa, Artificial Sequence
  Description of Artificial Sequence: Synthetic peptide
RHPGVTLVIYVARLFWHM

SEQ ID NO: 485 - protein, 18 aa, Artificial Sequence
  Description of Artificial Sequence: Synthetic peptide
QHPGVTLVIYVARLFWHW

SEQ ID NO: 486 - protein, 14 aa, Artificial Sequence
  Description of Artificial Sequence: Synthetic peptide
YHRMKPYLCYQLEQ

SEQ ID NO: 487 - protein, 8 aa, Artificial Sequence
  Description of Artificial Sequence: Synthetic peptide
KGCLLSEK

SEQ ID NO: 488 - protein, 12 aa, Artificial Sequence
  Description of Artificial Sequence: Synthetic peptide
VTITCYLTWSPC

SEQ ID NO: 489 - protein, 18 aa, Artificial Sequence
  Description of Artificial Sequence: Synthetic peptide
DRPDLILHIYTSRLYFHW

SEQ ID NO: 490 - protein, 14 aa, Artificial Sequence
  Description of Artificial Sequence: Synthetic peptide
CGRNESWLCFTMEV

SEQ ID NO: 491 - protein, 11 aa, Artificial Sequence
  Description of Artificial Sequence: Synthetic peptide
FRKRGVFRNQV

SEQ ID NO: 492 - protein, 12 aa, Artificial Sequence
  Description of Artificial Sequence: Synthetic peptide
YEVTWYTSWSPC

SEQ ID NO: 493 - protein, 18 aa, Artificial Sequence
  Description of Artificial Sequence: Synthetic peptide
RHSNVNLTIFTARLCYFW

SEQ ID NO: 494 - protein, 14 aa, Artificial Sequence
  Description of Artificial Sequence: Synthetic peptide
YGRNESWLCFTMEV

SEQ ID NO: 495 - protein, 11 aa, Artificial Sequence
  Description of Artificial Sequence: Synthetic peptide
SWKRGVFRNQV

SEQ ID NO: 496 - protein, 18 aa, Artificial Sequence
  Description of Artificial Sequence: Synthetic peptide
RHSNVNLTIFTARLYYFW

SEQ ID NO: 497 - protein, 14 aa, Artificial Sequence
  Description of Artificial Sequence: Synthetic peptide
NDRNETWLCFTVEG

SEQ ID NO: 498 - protein, 11 aa, Artificial Sequence
  Description of Artificial Sequence: Synthetic peptide
SWKTGVFRNQV

SEQ ID NO: 499 - protein, 12 aa, Artificial Sequence
  Description of Artificial Sequence: Synthetic peptide
YQVTWYTSWSPC

SEQ ID NO: 500 - protein, 18 aa, Artificial Sequence
  Description of Artificial Sequence: Synthetic peptide
RHSNVNLTIFTARLYYFQ

SEQ ID NO: 501 - protein, 14 aa, Artificial Sequence
  Description of Artificial Sequence: Synthetic peptide
RGRHETYLCYEVER

SEQ ID NO: 502 - protein, 11 aa, Artificial Sequence
  Description of Artificial Sequence: Synthetic peptide
NQRRGFLCNQA

SEQ ID NO: 503 - protein, 12 aa, Artificial Sequence
  Description of Artificial Sequence: Synthetic peptide
YRVTCFTSWSPC

SEQ ID NO: 504 - protein, 17 aa, Artificial Sequence
  Description of Artificial Sequence: Synthetic peptide
KNKHVSLCIFTARIYDD

SEQ ID NO: 505 - protein, 14 aa, Artificial Sequence
  Description of Artificial Sequence: Synthetic peptide
IGRHKTYLCYEVER

SEQ ID NO: 506 - protein, 11 aa, Artificial Sequence
  Description of Artificial Sequence: Synthetic peptide
DQHRGFLHNQA

SEQ ID NO: 507 - protein, 12 aa, Artificial Sequence
  Description of Artificial Sequence: Synthetic peptide
YRVTWFISWSPC

SEQ ID NO: 508 - protein, 17 aa, Artificial Sequence
  Description of Artificial Sequence: Synthetic peptide
ENTHVRLRIFAARIYDY

SEQ ID NO: 509 - protein, 14 aa, Artificial Sequence
  Description of Artificial Sequence: Synthetic peptide
LRRRQTYLCYEVER

SEQ ID NO: 510 - protein, 11 aa, Artificial Sequence
  Description of Artificial Sequence: Synthetic peptide
DQHMGFLCNEA

SEQ ID NO: 511 - protein, 14 aa, Artificial Sequence
  Description of Artificial Sequence: Synthetic peptide
TYPQTKHLTFYELR

SEQ ID NO: 512 - protein, 11 aa, Artificial Sequence
  Description of Artificial Sequence: Synthetic peptide
GLASNCTGSHT

SEQ ID NO: 513 - protein, 12 aa, Artificial Sequence
  Description of Artificial Sequence: Synthetic peptide
RHIILYSNNSPC

SEQ ID NO: 514 - protein, 19 aa, Artificial Sequence
  Description of Artificial Sequence: Synthetic peptide
NYPEVTLSVFFSQLYHTEM

SEQ ID NO: 515 - protein, 14 aa, Artificial Sequence
  Description of Artificial Sequence: Synthetic peptide
TFPQTKHLTFYELK

SEQ ID NO: 516 - protein, 11 aa, Artificial Sequence
  Description of Artificial Sequence: Synthetic peptide
GHASSCTGNYI

SEQ ID NO: 517 - protein, 19 aa, Artificial Sequence
  Description of Artificial Sequence: Synthetic peptide
TYPGITLSIYFSQLYHTEM

SEQ ID NO: 518 - protein, 14 aa, Artificial Sequence
  Description of Artificial Sequence: Synthetic peptide
KGRHETYLCYVVKR

SEQ ID NO: 519 - protein, 11 aa, Artificial Sequence
  Description of Artificial Sequence: Synthetic peptide
SLDFGHLRNKS

SEQ ID NO: 520 - protein, 12 aa, Artificial Sequence
  Description of Artificial Sequence: Synthetic peptide
YRVTWFTSWSPC

SEQ ID NO: 521 - protein, 18 aa, Artificial Sequence
  Description of Artificial Sequence: Synthetic peptide
WNPNLSLRIFTARLYFCE

SEQ ID NO: 522 - protein, 14 aa, Artificial Sequence
  Description of Artificial Sequence: Synthetic peptide
TYPQTKHLTFYELK

SEQ ID NO: 523 - protein, 12 aa, Artificial Sequence
  Description of Artificial Sequence: Synthetic peptide
RHIILYCNNSPC

SEQ ID NO: 524 - protein, 14 aa, Artificial Sequence
  Description of Artificial Sequence: Synthetic peptide
QKPRGTVILFYVEG

SEQ ID NO: 525 - protein, 11 aa, Artificial Sequence
  Description of Artificial Sequence: Synthetic peptide
AVNYNKQGTSI

SEQ ID NO: 526 - protein, 12 aa, Artificial Sequence
  Description of Artificial Sequence: Synthetic peptide
CTLHCYSTYSPC

SEQ ID NO: 527 - protein, 18 aa, Artificial Sequence
  Description of Artificial Sequence: Synthetic peptide
STGVRVVIHCCRIYELDV

SEQ ID NO: 528 - protein, 14 aa, Artificial Sequence
  Description of Artificial Sequence: Synthetic peptide
TERHRTYVIFDVKP

SEQ ID NO: 529 - protein, 9 aa, Artificial Sequence
  Description of Artificial Sequence: Synthetic peptide
LWGYIINNP

SEQ ID NO: 530 - protein, 12 aa, Artificial Sequence
  Description of Artificial Sequence: Synthetic peptide
YAMTWYMSWSPC

SEQ ID NO: 531 - protein, 19 aa, Artificial Sequence
  Description of Artificial Sequence: Synthetic peptide
EEQGHTLTMHFSRIYDRDR

SEQ ID NO: 532 - protein, 19 aa, Artificial Sequence
  Description of Artificial Sequence: Synthetic peptide
EEQGHTLMMHFSRLYDRDR

SEQ ID NO: 533 - protein, 14 aa, Artificial Sequence
  Description of Artificial Sequence: Synthetic peptide
KGRRETYLCYVVKR

SEQ ID NO: 534 - protein, 11 aa, Artificial Sequence
  Description of Artificial Sequence: Synthetic peptide
SLDFGYLRNKN

SEQ ID NO: 535 - protein, 18 aa, Artificial Sequence
  Description of Artificial Sequence: Synthetic peptide
GNPNLSLRIFTARLYFCE

SEQ ID NO: 536 - protein, 11 aa, Artificial Sequence
  Description of Artificial Sequence: Synthetic peptide
SLDFGHLRNKA

SEQ ID NO: 537 - protein, 19 aa, Artificial Sequence
  Description of Artificial Sequence: Synthetic peptide
GYPNLSLRIFTARLYFCDK

SEQ ID NO: 538 - protein, 14 aa, Artificial Sequence
  Description of Artificial Sequence: Synthetic peptide
SGRNKTFLCYVVEA

SEQ ID NO: 539 - protein, 11 aa, Artificial Sequence
  Description of Artificial Sequence: Synthetic peptide
QASRGYLEDEH

SEQ ID NO: 540 - protein, 12 aa, Artificial Sequence
  Description of Artificial Sequence: Synthetic peptide
YMVTWYVSSSPC

SEQ ID NO: 541 - protein, 18 aa, Artificial Sequence
  Description of Artificial Sequence: Synthetic peptide
KTKNLRLLILVGRLFMWE

SEQ ID NO: 542 - protein, 14 aa, Artificial Sequence
  Description of Artificial Sequence: Synthetic peptide
SGRNKTFLCYVVEV

SEQ ID NO: 543 - protein, 11 aa, Artificial Sequence
  Description of Artificial Sequence: Synthetic peptide
QATQGYLEDEH

SEQ ID NO: 544 - protein, 12 aa, Artificial Sequence
  Description of Artificial Sequence: Synthetic peptide
YNVTWYVSSSPC

SEQ ID NO: 545 - protein, 18 aa, Artificial Sequence
  Description of Artificial Sequence: Synthetic peptide
KTKNLRLLILVSRLFMWE

SEQ ID NO: 546 - protein, 10 aa, Artificial Sequence
  Description of Artificial Sequence: Synthetic peptide
EAALGYKEGG

SEQ ID NO: 547 - protein, 11 aa, Artificial Sequence
  Description of Artificial Sequence: Synthetic peptide
NKDGSVLGRGH

SEQ ID NO: 548 - protein, 12 aa, Artificial Sequence
  Description of Artificial Sequence: Synthetic peptide
KDTTLYTTLSPC

SEQ ID NO: 549 - protein, 13 aa, Artificial Sequence
  Description of Artificial Sequence: Synthetic peptide
GIPRCVVGENVNF

What is claimed is:

1. A cytidine base editor fusion protein comprising:

(i) a polynucleotide programmable DNA binding domain, and (ii) a cytidine deaminase comprising SEQ ID NO: 5 having an alteration selected from the group consisting of R33A, K34A, R52A, and H122A, further comprising between zero (0) and twenty (20) amino acid alterations at positions selected from the group consisting of positions 15 to 198, and comprising a F at amino acid position 120, wherein the cytidine base editor fusion protein has an increased ratio of in cis to in trans activity (in cis:in trans) as compared to a standard cytidine base editor fusion protein comprising a rat APOBEC-1 cytidine deaminase (rAPOBEC-1) and the polynucleotide programmable DNA binding domain, wherein the cytidine deaminase does not comprise SEQ ID NO: 4, and wherein "in cis" activity refers to on-target DNA base editing wherein the cytidine base editor is directed by a guide RNA, and "in trans" activity refers to unguided off-target editing events wherein the cytidine base editor is not directed by the guide RNA.

2. The cytidine base editor fusion protein of claim 1, wherein the standard cytidine base editor comprises a uracil glycosylase inhibitor (UGI) domain.

3. The cytidine base editor fusion protein of claim 1, wherein the standard cytidine base editor is a BE3 or BE4.

4. The cytidine base editor fusion protein of claim 1, wherein the cytidine deaminase comprises one or more alterations selected from the group consisting of R15A, R16A, H21A, R30A, K60A, R118A, H121A, H122L, R126A, R128A, R169A, R198A, T36A, H53A, V62A, L88A, W90F, W90A, H121R, H122R, R126E, W90Y, and R132E referenced to SEQ ID NO: 1.

5. The cytidine base editor fusion protein of claim 1, wherein the cytidine deaminase comprises a combination of alterations selected from the group consisting of:

K34A and R33A,
K34A and H122A,
K34A and R52A,
K34A and H122A,
K34A and H121A,
W90A and R126E,
W90Y and R126E,
H121R and H122R,
R126E and R132E,
W90Y and R132E, and
W90Y, R126E, and R132E referenced to SEQ ID NO: 1.

6. The cytidine base editor fusion protein of claim 1, wherein the cytidine deaminase comprises:

a) the alterations R33A, W90F, K34A, R52A, H122A, and H121A referenced to SEQ ID NO: 1;

b) a Y130X or R28X alteration referenced to SEQ ID NO: 1, wherein X is any amino acid;

c) a Y130A or R28A alteration referenced to SEQ ID NO: 1;

d) an H122X, K34X, R33X, W90X, or R128X alteration referenced to SEQ ID NO: 1, wherein X is any amino acid; or e) the alterations H122A, K34A, R33A, W90F, W90A, and R128A referenced to SEQ ID NO: 1.

7. The cytidine base editor fusion protein of claim 1, further comprising at least one adenosine deaminase or catalytically active fragments thereof.

8. The cytidine base editor fusion protein of claim 1, wherein the base editor comprises two adenosine deaminases that are capable of forming heterodimers or homodimers.

9. The cytidine base editor fusion protein of claim 1, wherein the at least one nucleobase editor domain further comprises an abasic nucleobase editor.

10. The cytidine base editor fusion protein of claim 1, further comprising one or more Nuclear Localization Signals (NLS).

11. The cytidine base editor fusion protein of claim 1, wherein the polynucleotide programmable DNA binding domain is a Cas9 selected from the group consisting of a *Staphylococcus aureus* Cas9 (SaCas9), a *Streptococcus pyogenes* Cas9 (SpCas9), a nuclease dead Cas9 (dCas9), a Cas9 nickase (nCas9), and a nuclease active Cas9.

12. An in vitro or ex vivo cell comprising the cytidine base editor fusion protein of claim 1.

13. A molecular complex comprising the cytidine base editor fusion protein of claim 1 and one or more of a guide RNA, a tracrRNA, and a target DNA molecule.

14. A method of editing a nucleobase of a nucleic acid sequence, the method comprising contacting a DNA molecule with the cytidine base editor fusion protein of claim 1 and converting a first nucleobase of the DNA molecule to a second nucleobase.

15. A polynucleotide molecule encoding the cytidine base editor fusion protein of claim 1.

16. An expression vector comprising a polynucleotide molecule of claim 15.

17. An in vitro or ex vivo cell comprising the polynucleotide molecule of claim 15 or a vector comprising the polynucleotide molecule of claim 15.

18. A kit comprising the fusion protein of claim 1, a polynucleotide encoding the cytidine base editor fusion protein of claim 1, a vector comprising the polynucleotide encoding the cytidine bae editor fusion protein of claim 1, or a molecular complex comprising the cytidine base editor fusion protein of claim 1 and a guide RNA.

19. The cytidine base editor fusion protein of claim 1, wherein said cytidine base editor fusion protein comprises less than ten (10) of the between 0 and 20 amino acid alterations at positions selected from the group consisting of positions 15 to 198.

20. The cytidine base editor fusion protein of claim 1, wherein said cytidine base editor fusion protein comprises less than five (5) of the between 0 and 20 amino acid alterations at positions selected from the group consisting of positions 15 to 198.

21. The cytidine base editor fusion protein of claim 1, wherein said cytidine base editor fusion protein comprises none of the between 0 and 20 amino acid alterations at positions selected from the group consisting of positions 15 to 198.

22. The cytidine base editor fusion protein of claim 1, wherein said cytidine base editor fusion protein comprises at least one (1) of the between 0 and 20 amino acid alterations at positions selected from the group consisting of positions 15 to 198.

23. The cytidine base editor fusion protein of claim 1, wherein said cytidine base editor fusion protein comprises at least five (5) of the between 0 and 20 amino acid alterations at positions selected from the group consisting of positions 15 to 198.

24. The cytidine base editor fusion protein of claim 1, wherein said cytidine base editor fusion protein comprises at least ten (10) of the between 0 and 20 amino acid alterations at positions selected from the group consisting of positions 15 to 198.

25. The cytidine base editor fusion protein of claim 1, wherein said cytidine base editor fusion protein comprises at least 15 of the between 0 and 20 amino acid alterations at positions selected from the group consisting of positions 15 to 198.

26. A cytidine base editor fusion protein comprising:

(i) a polynucleotide programmable DNA binding domain, and (ii) a cytidine deaminase comprising SEQ ID NO: 5 with an alteration selected from the group consisting of R33A, K34A, R52A, and H122A, further comprising between zero (0) and twenty (20) amino acid alterations at positions selected from the group consisting of positions 15, 16, 21, 28, 30, 36, 52, 53, 60, 62, 88, 90, 118, 121, 126, 128, 130, 132, 169, and 198, wherein the cytidine base editor fusion protein has an increased ratio of in cis to in trans activity (in cis:in trans) as compared to a standard cytidine base editor fusion protein comprising a rat APOBEC-1 cytidine deaminase (rAPOBEC-1) and the polynucleotide programmable DNA binding domain, wherein the cytidine deaminase does not comprise SEQ ID NO: 4, and wherein "in cis" activity refers to on-target DNA base editing wherein the cytidine base editor is directed by a guide RNA, and "in trans" activity refers to unguided off-target editing events wherein the cytidine base editor is not directed by the guide RNA.

27. A cytidine base editor fusion protein comprising:

(i) a polynucleotide programmable DNA binding domain, and (ii) a cytidine deaminase comprising SEQ ID NO: 5 with an alteration selected from the group consisting of R33A, K34A, R52A, and H122A, wherein the cytidine base editor fusion protein has an increased ratio of in cis to in trans activity (in cis:in trans) as compared to a standard cytidine base editor fusion protein comprising a rat APOBEC-1 cytidine deaminase (rAPOBEC-1) and the polynucleotide programmable DNA binding domain, wherein the cytidine deaminase does not comprise SEQ ID NO: 4, and wherein "in cis" activity refers to on-target DNA base editing wherein the cytidine base editor is directed by a guide RNA, and "in trans" activity refers to unguided off-target editing events wherein the cytidine base editor is not directed by the guide RNA.

* * * * *